US007820786B2

(12) United States Patent
Thomson et al.

(10) Patent No.: US 7,820,786 B2
(45) Date of Patent: Oct. 26, 2010

(54) SYNTHETIC PEPTIDES AND USES THEREFORE

(75) Inventors: Scott Anthony Thomson, New South Wales (AU); Ian Alistair Ramshaw, Australian Capital Territory (AU)

(73) Assignee: Savine Therapeutics Pty Ltd, Action, ACT (AU)

( * ) Notice: Subject to any disclaimer, the term of this patent is extended or adjusted under 35 U.S.C. 154(b) by 913 days.

(21) Appl. No.: 10/296,734

(22) PCT Filed: May 25, 2001

(86) PCT No.: PCT/AU01/00622

§ 371 (c)(1),
(2), (4) Date: Aug. 4, 2003

(87) PCT Pub. No.: WO01/90197

PCT Pub. Date: Nov. 29, 2001

(65) Prior Publication Data

US 2004/0054137 A1 Mar. 18, 2004

(30) Foreign Application Priority Data

May 26, 2000 (AU) .................... PQ7761

(51) Int. Cl.
*C07K 14/00* (2006.01)
*A61K 39/00* (2006.01)
*C12N 15/00* (2006.01)
(52) U.S. Cl. .................. 530/350; 424/184.1; 435/69.1; 435/5
(58) Field of Classification Search ........................ None
See application file for complete search history.

(56) References Cited

U.S. PATENT DOCUMENTS 5,639,854 A * 6/1997 Sia et al. ..................... 530/324

FOREIGN PATENT DOCUMENTS

| WO | WO 93/08280 A1 | 4/1993 |
| WO | WO 99/41368 | 8/1999 |
| WO | WO 99/41369 | 8/1999 |
| WO | WO99/41369 | * 8/1999 |
| WO | WO 99/41402 | 8/1999 |
| WO | WO 00/18906 | 4/2000 |

OTHER PUBLICATIONS

Wilkinson, B.M. "Distinct Domains within Yeast Sec61p Involved in Post-translational Translocations and Protein Dislocation" J. Biol. Chem. 2000; 275, 1:521-529.*
Arthos et al. Simian Immunodeficiency Virus DNA Vaccine Trial in Macaques. 1996, Journal of Virology, vol. 70, p. 3978-3991.*
Vaccine Concepts/Design, The NIAID Division of AIDS, 2003, p. 1-6.*
Lieberman et al. Blood, 1997, vol. 90, p. 2196-2206.*

Ada, G. L. (1993) Vaccines. Fundamental Immunology, Third Edition, William E. Paul, Raven Press, Ltd., New York. pp. 1309-1352.
An, L. L. and Whitton, J. L. (1997) A Multivalent Minigene Vaccine, Containing B-Cell, Cytotoxic T-Lymphocyte, and $T_h$ Epitopes from Several Microbes, Induces Appropriate Responses In Vivo and Confers Protection against More than One Pathogen. J. Virol. 71(3):2292-2302.
Boyle, D. B., et al. (1985) Multiple-cloning-site plasmids for the rapid construction of recombinant poxviruses. Gene 35:169-177.
Brown, J. H., et al. (1993) Three-dimensional structure of the human class II histocompatibility antigen HLA-DR1. Nature 364:33-39.
Chicz, R. M., et al. (1993) Specificity and Promiscuity among Naturally Processed Peptides Bound to HLA-DR Alleles. J. Exp. Med. 178:27-47.
Coward, E. (1999) Shufflet: shuffling sequences while conserving the κ-let counts. Bioinformatics 15(12):1058-1059.
Crameri, A., et al. (1998) DNA shuffling of a family of genes from diverse species accelerates directed evolution. Nature 391:288-291.
Del Val, M., et al. (1991) Efficient Processing of an Antigenic Sequence for Presentation by MHC Class I Molecules Depends on Its Neighboring Residues in the Protein. Cell 66:1145-1153.
Dyall, R., et al. (1995) CD4-independent in vivo priming of murine CTl by optimal MHC class I-restricted peptides derived from intracellular pathogens. Int. Immunol. 7(8)1205-1212.
Fisch, I., et al. (1996) A strategy of exon shuffling for making large peptide repertoires displayed on filamentous bacteriophage. PNAS 93:7761-7766.
Fremont, D. H., et al. (1992) Crystal Structures of Two Viral Peptides in Complex with Murine MHC Class I H-$2K^b$. Science 257:919-927.
Gao, F., et al. (1996) The Heterosexual Immunodeficiency Virus Type 1 Epidemic in Thailand Is Caused by an Intersubtype (A/E) Recombinant of African Origin. J. Virol. 70(10):7013-7029.
Giver, L. and Arnold, F. (1998) Combinatorial protein design by in vitro recombination: Current Opinion in Chem. Biol. 2:335-338.
Goulder, P. J. R., et al. (1997) Patterns of Immunodominance in HIV-1-specific Cytotoxic T Lymphocyte Responses in Two Human Histocompatibility Leukocyte Antigens (HLA)-identical Siblings with HLA-A*0201 Are Influenced by Epitope Mutation. J. Exp. Med. 185(8):1423-1433.

(Continued)

*Primary Examiner*—Zachariah Lucas
*Assistant Examiner*—Agnieszka Boesen
(74) *Attorney, Agent, or Firm*—Knobbe Martens Olson & Bear LLP

(57) ABSTRACT

Aspects of the present invention are related to a synthetic polypeptide comprising a plurality of different segments from one or more parent polypeptides, linked together in such a way that is different from their linkage in the one or more parent polypeptides, in such way as to impede, abrogate or otherwise alter at least one function associated with the linkage in the one or more parent polypeptides, and in such a way that their product is not similar in function and/or structure to at least a portion of the one or more parent polypeptides. Additional aspects include a synthetic polynucleotide encoding the synthetic polypeptide, methods of production, a synthetic construct and methods of using the synthetic polypeptide, nucleotide construct and compositions comprising the above. Another aspect is directed towards a computer program product for designing these synthetic polypeptides and polynucleotides.

35 Claims, 217 Drawing Sheets

OTHER PUBLICATIONS

Ishioka, G. Y., et al. (1999) Utilization of MHC Class I Transgenic Mice for Development of Minigene DNA Vaccines Encoding Multiple HLA-Restricted CTL Epitopes. J. Immunol. 162:3915-3925.

Kent, S. J., et al. (1998) Enhanced T-Cell Immunogenicity and Protective Efficacy of a Human Immunodeficiency Virus Type 1 Vaccine Regimen Consisting of Consecutive Priming with DNA and Boosting with Recombinant Fowlpox Virus. J. Virol. 72(12):10180-10188.

Kwong, P. D., et al. (1998) Structure of an HIV gp120 envelope glycoprotein in complex with the CD4 receptor and a neutralizing human antibody. Nature 393:648-659.

Mizuuchi, K., et al. (1982) T4 Endonuclease VII Cleaves Holliday Structures. Cell 29:357-365.

Newcomb, J. R. and Cresswell, P. (1993) Characterization of Endogenous Peptides Bound to Purified HLA-DR Molecules and Their Absence from Invariant Chain-Associated αβ Dimers. J. Immunol. 150:499-507.

Ogg, G. S., et al. (1998) Quantitation of HIV-1-Specific Cytotoxic T Lymphocytes and Plasma Load of Viral RNA. Science 279:2103-2106.

Parmiani, G. (1998) Future Perspectives in Specific Immunotherapy of Melanoma. Eur. J. Cancer 34(Suppl 2):S42-S47.

Patten, P. A., et al. (1997) Applications of DNA shuffling to pharmaceuticals and vaccines. Curr. Opin. Biotechnol. Pharmaceutical Biotech. 8(6):724-733.

Persson, H., et al. (1980) Multiple mRNA species for the precursor to an adenovirus-encoded glycoprotein: Identification and structure of the signal sequence. PNAS 77(11):6349-6353.

Punnonen, J. (2000) Molecular Breeding of Allergy Vaccines and Antiallergic Cytokines. Int. Arch. Allergy Immunol. 121:173-182.

Rotzschke, O., et al. (1990) Isolation and analysis of naturally processed viral peptides as recognized by cytotoxic T cells. Nature 348:252-254.

Rowland-Jones, S., et al. (1995) HIV-specific cytotoxic T-cells in HIV-exposed but uninfected Gambian women. Nature Medicine 1(1):59-64.

Rowland-Jones, S., et al. (1998) Cytotoxic T Cell Responses to Multiple Conserved HIV Epitopes in HIV-Resistant Prostitutes in Nairobi. J. Clin. Invest. 102(9)1758-1765.

Ryu, D. D. Y. and Nam, D. H. (2000) Recent Progress in Biomolecular Engineering. Biotechnol. Prog. 16:2-16.

Salminen, M. O., et al. (1996) Full-Length Sequence of an Ethiopian Human Immunodeficiency Virus Type 1 (HIV-1) Isolate of Genetic Subtype C. Aids Res. Human Retroviruses 12(14):1329-1339.

Sandhu, G. S., et al. (1992) Dual Asymmetric PCR: One-Step Construction of Synthetic Genes. BioTechniques 12(1):14-16.

Stemmer, W. P. C. (1994) DNA shuffling by random fragmentation and reassembly: In vitro recombination for molecular evolution. PNAS 91:10747-10751.

Stemmer, W. P. C. (1994) Rapid evolution of a protein in vitro by DNA shuffling. Nature 370:389-391.

Thomson, S. A., et al. (1995) Minimal epitopes expressed in a recombinant polyepitope protein are processed and presented to CD84+ cytotoxic T cells: Implications for vaccine design. PNAS 92:5845-5849.

Thomson, S. A., et al. (1996) Recombinant Polyepitope Vaccines for the Delivery of Multiple CD8 Cytotoxic T Cell Epitopes. J. Immunol. 157:822-826.

Thomson, S. A., et al. (1998) Delivery of Multiple CD8 Cytotoxic T Cell Epitopes by DNA Vaccination. J. Immunol. 160:1717-1723.

Thomson, S. A., et al. (1998) Targeting a Polyepitope Protein Incorporating Multiple Class II-Restricted Viral Epitopes to the Secretory/Endocytic Pathway Facilitates Immune Recognition by CD4+ cytotoxic T Lymphocytes: a Novel Approach to Vaccine Design. J. Virol. 72(3):2246-2252.

Townsend, A. R. M., et al. (1986) The Epitopes of Influenza Nucleoprotein Recognized by Cytotoxic T Lymphocytes Can Be Defined with Short Synthetic Peptides. Cell 44:959-968.

Woodberry, T., et al. (1999) Immunogenicity of a Human Immunodeficiency Virus (HIV) Polytope Vaccine Containing Multiple HLA A2 HIV CD8+ Cytotoxic T-Cell Epitopes. J. Virol. 73(7):5320-5325.

Youil, R., et al. (1995) Screening for mutations by enzyme mismatch cleavage with T4 endonuclease VII. PNAS 92:87-91.

Zhao, H., et al. (1998) Molecular evolution by staggered extension process (StEP) in vitro recombination. Nature Biotechnol. 16:258-261.

Lieberman, J. et al. 1992 "Cytotoxic T Lymphocytes from HIV-1 seropositive individuals recognize immunodominant epitopes in gp160 and reverse transcriptase" *J Immunol* 148:2738-3747.

\* cited by examiner

```
                p17 ->        /<-         nls      ->/
                        /<-   membrane binding     ->/

DESIGNED SEQ   MGARASVLSGGKLDAWEKIRLRPGGKKKYKMKHLVWASRELERFALNPGLLETAEGCQQILEQLQSALKT    70
MUTATED AAs         R    E                RL  I             S           S    K  G  P Q

E-ISOLATE      MGARASVLSGGKLDAWEKIRLRPGGKKKYKMKHLVWASRELERFALNPGLLETAEGCQQLIEQLQSTLKT    70

CONSENSUS-A    mGARaSvLsggkLDawekIrLRPgGkKkYrlKHlvwAsreLerFaLnPslLeTaegcgqimeQlqsalkT    70
CONSENSUS-B    ------------e--r-------------k---i------------v--g----s---R--lg---ps-q-   70
CONSENSUS-C    ------i-r-----?-----------h-Mi----------------g----s---k--ik---P--Q-     69
CONSENSUS-D    ---------------?---------------?---i-------------G----s---k--ig---P-iq-   68
CONSENSUS-F    ----------------------------------------------i--g----s---rk-Ig---pS-Q-   70
CONSENSUS-G    --------------?---------?--?------------?-----G----T------??---P?-Q-     63
CONSENSUS-H    ------------?-------------?-----------------?--?-?---L-?I----P----       64
CONSENSUS-O    ---?----T-S------?---?--S--?----------------?-C--?-------?E?LLQ--EP----   62
CONSENSUS-CPZ  ---?----?-?----?-??------?-?-M?------??--?---????-?-??---?K???--?P????   42

/<- nls ->/

DESIGNED SEQ   GSEELKSLYNTIATLWCVHQRIEVKDTKEALDKIEEEQKKSQQK......TQQAAA..DT.GS...SSKV
MUTATED AAs        T   R F V          D R          VN  K            N    . Q

E-ISOLATE      GSEELKSLYNTIATLWCVHQRIEVKDTKEALDKIEEVQKKSQQKK......QQAAA..DT.GS...SSKV

CONSENSUS-A    g?eElkSLfNtvatLycvHqrIdvkDtKeAldkiEeiqnKskqk??????tqqaaA..?T.gs?...sskv  126
CONSENSUS-B    -s---r--y------------e------------E-----k-......a-----??d-.-n???--q-    128
CONSENSUS-C    -T---r--?---------??-e-r-----------E---?Q----.....----k-.aD?.-k.......-  120
CONSENSUS-D    -s------?--------e--e---------e-m--E-----k----.....a---t-..D-.rn...-Q-  125
CONSENSUS-F    -S---r--y----v--f----vE----------L--E----q---..........---?---.dK.------ 123
CONSENSUS-G    -T---?---?-??-?-?-.?----e--------eEV-Ka-kn-Q---......?---??..e?--n..--q- 110
CONSENSUS-H    -T---Q----LL-?---------?-------?--?-?--??0??..........T?..DK.??...??-?   106
CONSENSUS-O    -S??-?--W-AI?V-W----N-??I?--QQ-IQ-LK-V.M?-RKS...A-AAKE........-....PRQ?  106
CONSENSUS-CPZ  ?S????------??V-W-?-??????--??-????K??????Q??T-S---???G????-????-??????  61 p17 \/ p24

DESIGNED SEQ   ....SQNYPIVQNAQGQMVHQPLSPRTLNAWVKVIEEKGFNPEVIPMFSALSEGATPQDLNMMLNIVGGH
MUTATED AAs              L       AI             V   AS     T              T   T

E-ISOLATE      ....SQNYPIVQNAQGQMVHQPLSPRTLNAWVKVIEEKGFNPEVIPMFSALSEGATPQDLNMMLNIVGGH

CONSENSUS-A    ????SqNYPIVQNaqgQm?hQ?lSPrTLnAwVKviEekaFspEVIPmFsaLSEGATpQdLNmmLNiVgGH    190
CONSENSUS-B    ....----------l----V--ai-----------v----------------------T---T----       194
CONSENSUS-C    ....----------L----v--ai---------------?----T------------T---T----        185
CONSENSUS-D    ....----------L----V--ai----------------------------------t---T----       191
CONSENSUS-F    ....----------l----V--i-----------v-----------------------T---T----       188
CONSENSUS-G    ....---------?------i-------------v-----------------------t---T----       174
CONSENSUS-H    ....-------------?V--AI-----------V-------------------------A---?----     170
CONSENSUS-O    ....?------?------V--AI----------AV-----N--I----M------??Y-I-T--AI---     168
CONSENSUS-CPZ  ----??---????-?-??----??---------?V---?-?---------------?-?-?-T---A--?-   107

DESIGNED SEQ   QAAMQMLKETINEEAAEWDRVHPVHAGPIPPGQMREPRGSDIAGTTSTLQEQIGWMTN...NPPIPVGDI
MUTATED AAs           D            I         VA I                  A   S      V    E

E-ISOLATE      QAAMQMLKETINEEAAEWDRVHPVHAGPIPPGQMREPRGSDIAGTTSTLQEQIGWMTN...NPPIPVGDI

CONSENSUS-A    QAAMQMLKdtINeEAAewDr?HPVhAgPippgQmREPrGSDIAGtTStlqEqigwmTs...NPPiPVGdI    256
CONSENSUS-B    --------e----------l-------a-----------------------n...-------e-          261
CONSENSUS-C    -------------l-------vA-----------------a---?...----------                251
CONSENSUS-D    --------E------------l-------A-----------------?----...-------e-          257
CONSENSUS-F    -----------------L---q-------i----------------q----...---v---e-           255
CONSENSUS-G    -----------------I--?Q-------I-?---------------R----....------e-          239
CONSENSUS-H    -----?------------------------------------------A---?....--?------        233
CONSENSUS-O    -G-L-V--EV-----?----T--P??--L----I---T---------Q----?-T-R.??-??------     229
CONSENSUS-CPZ  -G---V--EV----------L--T---???--L---?---------?---??-??????-???----?      160

/<-   MHR    ->/
```

FIGURE 3

```
                              p24 \/  \/      'p2'      \/ p7        Zn-motif
                                                                     /<-
DESIGNED SEQ  SILKALGTGATLEEMMTACQGVGGPSHKARVLAEAMSQA...TH.AN...IMMQRGNF.KGQKRIIKCFN
MUTATED AAs      T R   P  S                 G               V  NN        R P    V ISOLATE-E     SILKALGTGATLEEMMTACQGVGGPSHKARVLAEAMSQA...QH.AN...IMMQRGNF.KGQTR.IKCFN CONSENSUS-A   sILraLg?gAtLeEMMTacQgVggPgHKArvLAEAmSqv...q???n??.iMmQrGnf.rgqkr?iKCFN  384
CONSENSUS-B   T--K---Pa------------------------------...tn-s.at?--------.-n-rKtv----  394
CONSENSUS-C   T------P--s--------------------s-------...a...nn.--.-----s--.K-p--iv----  382
CONSENSUS-D   t--K---P?------------------------s-----...a...tn.s-ta.--------.K-prki-----  390
CONSENSUS-F   T--K---P-------------------------------...a...TN.-?a-.----ks--.K--R-iv----  386
CONSENSUS-G   T--?---P-----------------?-------------...A...SG.-A-A.?---K??-.K-P??-----?  360
CONSENSUS-H   ?--?------SI------------?---?---------?..TN.-?A-.?---K---.K--R-I?----  353
CONSENSUS-O   Q--K?--P?-------V---------T---??-----A?AQQDLKGGYTA.VF----QN.P?R-G------  358
CONSENSUS-CPZ ?--K------?----?---------?----------?????.?Q.-?-?.VF?-?-?G??-?---?----  262 pol cds ->
              Zn-motif ->/   /<-Zn-motif ->/  p7 \/   'p1'    \/ p6
DESIGNED SEQ  CGKEGHLARNCRAPRKKGCWKCGKEGHQMKDCT..E.RQANFLGKIWPSNKG.RPGNFPQSKP.......
MUTATED AAs          I K                 R                 H         L  R
                                                          S
ISOLATE-E     CGKEGHLARNCRAPRKKGCWKCGKEGHQMKDCT..E.RQANFLGKIWPSNKG.RPGNFPQSKP.......

CONSENSUS-A   CGkEGHlArNCrAPrKkGCwKCgkEGHQmKdCT.?e.rQANFlgkiwpSsKG.RPgNFpQsRp.......  443
CONSENSUS-B   ------i-k-------------------.--?-----------h--.-----l----???????  453
CONSENSUS-C   ------i------------------?----------..-.-----------?--.-----L----???????  439
CONSENSUS-D   ------i-k---------------------------..-.-----------h--.-----l----.......  449
CONSENSUS-F   ------i-k---------------r-----------..-.-----------n--.-----L----.......  445
CONSENSUS-G   ---------------?------?-------------..-.--------?----H--.-----L-?-?.......  414
CONSENSUS-H   ------?----------------?-----------..-.--------???--.-----L-----.......  406
CONSENSUS-O   ------I-?-------?------Q--------?..NG?-------Y--PGGT.----YV-???.......  411
CONSENSUS-CPZ ------?-----K---R----R--Q----?-?-??-????V-----??-???-?-----V-?????.....  306 vpr binding                                vpr binding      p6
                                                                        terminus
              /<--->/          \/ (minor)       (minor) \/  /<- ->/    / (80%)
DESIGNED SEQ  .......EPTAPPAE.......NF.GFGEETT.PS....PKQEQKD....KEHYPPSASLKSLFGNDPLSQ
MUTATED AAs                S         R          Q    P       L   L            S ISOLATE-E     .......EPTAPPAE.......NW.GMGEE.............QKD....KEHPPPSVSLKSLFGNDPLSQ CONSENSUS-A   .......EPtAPpAE.......?f?gmgeeit.s?....pkqeqkd..??ke??ppl?slKSlFGNDplSQ  485
CONSENSUS-B   ??..???------e-........s-.rf---t-tps????q---pi-...----lY?--a--r-------s--$  500
CONSENSUS-C   ???????---------???????S-.rF.--t-.pa....----p--??--?---?-t----------x  479
CONSENSUS-D   .......---------.......S-.-F-----.Ps....q------??----ly.--a-------------  495
CONSENSUS-F   .......---------.......s-.-F?----.PS....----------egly--a----  482
CONSENSUS-G   .......--?-----........-?.???---?.?S........----P??.....--LY?-------  440
CONSENSUS-H   .......---------.......S-.-F---M-.P-....----??-....-?-..?-------  436
CONSENSUS-O   .......?-S---M-..............-?VK.?Q....EN-?--G..--?-LY.-FA-------T-Q$  444
CONSENSUS-CPZ .......------I-........-Y.??Q--?K.?-.....?-?????....??L---?--------?-??--  333
```

CONSENSUS A-CPZ FROM LOS ALAMOS HIV SEQUENCE DATABASE
ISOLATE-E SEQ FROM ISOLATE 93TH253 THAILAND

Underlined AA are not present in all overlapping segments

FIGURE 3 (Cont)

```
DESIGNED SEQ    FFRE.NLAFQQGKAREF...........SSE..QTGANSSASRKLGDGGG.............AER..Q          [SEQ ID NO:2]
MUTATED AAS         P   E            P    R  PT                  D

ISOLATE-E       FFRE.NLAFQQGKAREF...........SSE..QTGANSSASRKLGDGGG.............AER..Q          [SEQ ID NO:1470]

CONSENSUS-A     FFRE.NLAFQQGEAR?F...........SSE..QT??NS?TSR?LWDGG?D??.L?....???G?E?..Q     35  [SEQ ID NO:1471]
CONSENSUS-B     ----.d---p--k--e-??????????????---..--Ra--p-r-E-qVw-r-nnS-S???-EA-adr.-     49
ISOLATE-C       ----.T------K--E-...........P--..--RA--P-T---QV.RGSN....T.FSEAGAER..Q
CONSENSUS-D     ----.d---P--K-GE1...........---..--RA--P---E-RVW-r-.NP-S....eT-A-R..-     48
CONSENSUS-O     ---?.?--SGGH---QL...........--..CA--..TS-PI-P-?.....--GSE.....GT-ES?---G??   35
CONSENSUS-U     ----.----P--K--E-...........P--..--RA--P---E-RVW-G-K.T-S....ET-A-R..-     48
CONSENSUS-CPZ   ----????????????--L..........CA-????---?--?-????-?--??-.....--?-?-???     13 protease
                        \/           <- gag cds end
DESIGNED SEQ    GT..SSSFSFPQITLWQRPLVTIKIGGQLKEALLDTGADDTVLEDINLPGKWKPKMIGGIGGFIKVRQYD          [SEQ ID NO:2]
MUTATED AAS         LN                   V  I                EM    R ISOLATE-E       GT..SSSFSFPQITLWQRPLVTIKIGGQLKEALLDTGADDTVLEDINLPGKWKPKMIGGIGGFIKVRQYD          [SEQ ID NO:1470]

CONSENSUS-A     G?..??SF?FPQITLWQRPLVTV?I?GQLIEALLDTGADDTVLEDINLPGKWKPK?IGGIGGFIKVRQYD      96  [SEQ ID NO:1471]
CONSENSUS-B     -...tV--s-------------ik-g---K-------------eM----r----M--------------     116
ISOLATE-C       -.....-LN-------------IK-G---K-------------E---------M--------------
CONSENSUS-D     -...TV--n-------------IK-G---K-------------Em--------M--------------     115
CONSENSUS-O     R...A-??CL---P--D--I--A-VG-H-C-?-----------NN-Q-E-?-?--M----------KE-?     94
CONSENSUS-U     -...IV--S--------V---RVG---K-------------E---------M--------------     115
CONSENSUS-CPZ   ?-??---?-?-?-?-----???--?---?C?-----------?-?-?-Q-?--------------?-?-??    55 protease \/ p66, p51
DESIGNED SEQ    QILIEICGKKAIGTVLVGPTPVNIIGRNMLTQIGCTLNFPISPIDTVPVKLKPGMDGPKVKQWPLTEEKI          [SEQ ID NO:2]
MUTATED AAS         I   H              L   L R         E ISOLATE-E       QILIEICGKKAIGTVLVGPTPVNIIGRNMLTQIGCTLNFPISPIDTVPVKLKPGMDGPKVKQWPLTEEKI          [SEQ ID NO:1470]

CONSENSUS-A     QILIEICGKK?IGTVLVGPTPVNIIGRNMLTQIGCTLNFPISPIETVPVKLKP?MDGPKVKQWPLTEEKI     164 [SEQ ID NO:1471]
CONSENSUS-B     --------H-A-----------L-------------------G-----------------           186
ISOLATE-C       --I-------A-------------M---L-R-----------------G-----------------
CONSENSUS-D     --------?-A-----------L-------------------G-----------------           184
CONSENSUS-O     NVTV-??-?EVQ------------?---I--GL-----------AP-------G-----------S?---   159
CONSENSUS-U     ----------A---I--------------------------------G----R----------        185
CONSENSUS-CPZ   ?V?-?-??R?V??----?--?---------??--?L----?----??--------?G----?------S?---  106

|  M41L         D67N |   | K70R
DESIGNED SEQ    KALTEICKEMEEEGKISKIGPENPYNTPVFAIKKKDSTKWRKLVDFRELNKRTQDFWEVQLGIPHPAGLK .        [SEQ ID NO:2]
MUTATED AAS         A   T      K    R           I
                        Q

ISOLATE-E       KALTEICKEMEEEGKISKIGPENPYNTPVFAIKKKDSTKWRKLVDFRELNKRTQDFWEVQLGIPHPAGLK          [SEQ ID NO:1470]

CONSENSUS-A     KALT?IC?EMEKEGKISKIGPENPYNTPVFAIKKKDSTKWRKLVDFRELNKRTQDFWEVQLGIPH?AGLK     231 [SEQ ID NO:1471]
CONSENSUS-B     ---vE--T------------------------------------------------P----             256
ISOLATE-C       ----A--E---Q-----R------------------------------------P----
CONSENSUS-D     ----E--T---------R----------I---------------------------P----             254
CONSENSUS-O     E---A--Q---Q-----R----------I--------?----------------?--------PG---        227
CONSENSUS-U     ----E--KD------L----------------------N-------------------P----           255
CONSENSUS-CPZ   ?--?E---??-?-?---?---?------I--------??--------------------?------P----   164

DESIGNED SEQ    KKKSVTVLDVGDAYFSVPLDESFRKYTAFTIPSINNETPGIRYQYNVLPQGWKGSPAIFQSSMTKILEPF          [SEQ ID NO:2]
MUTATED AAS                     KD       T                              P      PQ
                                G

ISOLATE-E       KKKSVTVLDVGDAYFSVPLDESFRKYTAFTIPSINNETPGIRYQYNVLPQGWKGSPAIFQSSMTKILEPF          [SEQ ID NO:1470]

CONSENSUS-A     KKKSVTVLDVGDAYFSVPLD??FRKYTAFTIPS?NNETPG?RYQYNVLPQGWKGSP?IFQ?SMTKILEPF     295 [SEQ ID NO:1471]
CONSENSUS-B     -----------------kd----------i------i----------------A---s---------        326
ISOLATE-C       -----------------EG----------T------I----------------P---S--PQ-----
CONSENSUS-D     -----------------eD----------I------I----------------A---S---------        324
CONSENSUS-O     Q?Q-------------C---PD----------V---------------------A---S------D--       295
CONSENSUS-U     -----------------ED----------I------I----------------A---S---------        325
CONSENSUS-CPZ   ?----------------?----D--------------?-----------------------?--           225 polymerase motif
                  /<-->/                       T215Y |    | K219Q
DESIGNED SEQ    RIKNPEMVIYQYMDDLYVGSDLEIGQHRTKIEELRAHLLRWGFTTPDKKHQKEPPFLWMGYELHPDRWTV         [SEQ ID NO:2]
MUTATED AAS         KQ  D                        A          E    K
                                                              Q ISOLATE-E       RIKNPEMVIYQYMDDLYVGSDLEIGQHRTKIEELRAHLLSWGFTTPDKKHQKEPPFLWMGYELHPDRWTV          [SEQ ID NO:1470]

CONSENSUS-A     R???P?IVIYQYMDDLYVGSDLEIGQHRAKIEELR?HLL?WGF?TPDKKHQKEPPFLWMGYELHPDKWTV     358 [SEQ ID NO:1471]
CONSENSUS-B     -KQN-d----------------------t------q---r---t----------------            396
ISOLATE-C       -APN-E----------------------P------E---K---T----------------
CONSENSUS-D     -KQN-E----------------------T------E---R---T----------------            394
CONSENSUS-O     ---N-E?E-?--?---------PL?E--KR?-L--E--YQ---T----------------             358
CONSENSUS-U     -TKN-E----------------------T------E---K---T----------------            395
CONSENSUS-CPZ   --K---??-----------?--??--???-?--Q--?---?-------------?--------          278
```

FIGURE 4

```
DESIGNED SEQ    QPIELPEKDSWTVNDIQKLVGKLNWASQIYAGIKVKQLCKLLRGTKALTDIVPLTEEAELELEENREI..          [SEQ ID NO:2]
MUTATED AAS        V    E                     P    R        A    E  T         A
                   Q
ISOLATE-E       QPIELPEKDSWTVNDIQKLVGKLNWASQIYAGIKVKQLCKLLRGTKALTDIVPLTEEAELELEENREI..          [SEQ ID NO:1470]

CONSENSUS-A     QP??LPEKDSWTVNDIQKLVGKLNWASQIYAGIK?KQLC?LLRGAKALTDIV?LTEEAELELAENREI..    421   [SEQ ID NO:1471]
CONSENSUS-B     --Iv--------------------------V----k----t----Evip--------------..    464
ISOLATE-C       --IQ------------------------P---VR---K-----------T--------------..
CONSENSUS-D     -sIk----E-------------------p---Vr---K----T----EViP--------------..    462
CONSENSUS-O     -?IQ--?-?V---------?----------Q--RV?E--K-I--T-S--EV-P-S?------E----?..    419
CONSENSUS-U     --IQ--D-E-------------------P---V----K------------P--A-----------..    463
CONSENSUS-CPZ   -?I----???---------?----------P----------I--?-?---?--?-?------?--??-??    329

DESIGNED SEQ    .LREPVHGVYYDPSKDLVAEVQKQGQDQWTYQIYQEPFKNLKTGKYSRKRSAHTNDVRQLTEVVQKIATE          [SEQ ID NO:2]
MUTATED AAS       K              I  I     G   F  F(error)     A M G      K   AA   V ISOLATE-E       .LRIPVHGVYYDPSKDLVAEVQKQGQDQWTYQIYQEPFKNLKTGKYSRKRSAHTNDVRQLTEVVQKIATE          [SEQ ID NO:1470]

CONSENSUS-A     .LK?PVHGVYYDP?KDLVAE?QKQGQDQWTYQIYQEPFKNLKTGKYA?KRSAHTNDVKQLTEVVQKV??E    484   [SEQ ID NO:1471]
CONSENSUS-B     .--e---------s---i--i-----g-------------------rm-G-----------A---iat-    533
ISOLATE-C       .--E-----F---S---I--I----N----F-F-----------F-.--T----------A----IAL-
CONSENSUS-D     .--E---------S---I--i----hG-------------------Rm-G---------a-a---IsT-    531
CONSENSUS-O     .----------Q-D---WV?I--?-??-----?--?EH--------?RQKAS----IR--A--?---SQ-    479
CONSENSUS-U     .--E---------S---I--I-----G---------QY---------RIK------------A---IAQ-    532
CONSENSUS-CPZ   ???-???-?--?--??-?-?I----??------?-???-?--?----R????---??R--A??---I---    367 p51 \/
DESIGNED SEQ    SIVIWGKTPKFRLPIQRETWETWWMEYWQATWIPEWEFVNTPPLVKLWYQLEKDPIVGAETFYVDGAASR          [SEQ ID NO:2]
MUTATED AAS                K    K    A  TD                           E  A V         N

ISOLATE-E       SIVIWGKTPKFRLPIQRETWETWWMEYWQATWIPEWEFVNTPPLVKLWYQLEKDPIVGAETFYVDGAASR          [SEQ ID NO:1470]

CONSENSUS-A     SIVIWGK?PKFRLPIQ?ETWE?WWMEYWQATWIPEWEFVNTPPLVKLWYQLEKDPI?GAETFYVDGAANR    550   [SEQ ID NO:1471]
CONSENSUS-B     -------t---k----K-------t---------------------------e--v------------    602
ISOLATE-C       -------T--------K----A--TD--------------------------E--A-V----------
CONSENSUS-D     -------T--------K----T--?---------------------------E--I------------    600
CONSENSUS-O     ?-?----L---?--VTR----T--A?-------------S----I----?--?E-------?--------    541
CONSENSUS-U     -------T--------K----A--T--------------------------TE--V------------    602
CONSENSUS-CPZ   ------?----?--??--?-?A--??------------?-----??---?-???--P???-?--------    416

DESIGNED SEQ    ETKLGKAGYVTDRGRQKVISLTETTNQKTELHAIHLALQDSGSEVNIVTDSQYALGIIQAQPDRSESEVV          [SEQ ID NO:2]
MUTATED AAS                      IV   D        Q  Q       L               L    K    L

ISOLATE-E       ETKLGKAGYVTDRGRQKVISLTETTNQKTELHAIHLALQDSGSEVNIVTDSQYALGIIQAQPDRSESEVV          [SEQ ID NO:1470]

CONSENSUS-A     ETK?GKAGYVTDRGRQKVVSLTETTNQKTELHAIHLALQDSGSEVNIVTDSQYALGIIQAQPDRSESE?V    618   [SEQ ID NO:1471]
CONSENSUS-B     ---l-----------------d--------q---------l------------------k----l-    672
ISOLATE-C       ---I------------I------------Q--Q------------------------L----K----I-
CONSENSUS-D     ---L---------------Pf-D--------Q--N-------L--------------------K----L-    670
CONSENSUS-O     ?--L-------EQ-K-?IIK-?------A--M-?L?-----KE?---------?--?-SS--TQ-?-PI-    602
CONSENSUS-U     ---K-------------------------Q-------------------------------K----I-    672
CONSENSUS-CPZ   ???---------?-??????-??----QA--?-?L?--?--???---------?--??-??--?---?L-    459

DESIGNED SEQ    SQIIEELIKKEKVYLSWVPAHKGIGGNEQVDKLVISGIRKVLFLDGINKAQEEHERYHSNWRTMASDFNL          [SEQ ID NO:2]
MUTATED AAS     N    K     R   A                  SA           D       K         NE
                     Q
ISOLATE-E       SQIIEELIKKEKVYLSWVPAHKGIGGNEQVDKLVISGIRKVLFLDGINKAQEEHERYHSNWRTMASDFNL          [SEQ ID NO:1470]

CONSENSUS-A     NQIIEKLI?K?KVYLSWVPAHKGIGGNEQVDKLVS?GIRKVLFLDGIDKAQE?HE?YH?NW?AMASDFNL    681   [SEQ ID NO:1471]
CONSENSUS-B     s----q--K-E----a------------------a---------------e--K--s--r--------    742
ISOLATE-C       -----Q--S-ER----------------------S----------------E--K--S--R---NE--I
CONSENSUS-D     s----Q--K-E----A------------------Q----------------E--K--N--R--------    740
CONSENSUS-O     Q----E-TK-E?---T------------KI-----KD--R----E---Q---D--K--S----L--?-G-    669
CONSENSUS-U     -----Q--Q-D-----------------------S----------------E--K--S--R--------    742
CONSENSUS-CPZ   ??--??--K?E?I-------------------------?----?---?-----?---S---??-???--    510

DESIGNED SEQ    PPIVAKEIVANCDKCQLKGEAMHGQVDCSPGIWQLDCTHLEGKVILVAVHVASGYIEAEVIPAETGQETA          [SEQ ID NO:2]
MUTATED AAS         P     S          I    N                I
                       C
ISOLATE-E       PPIVAKEIVANCDKCQLKGEAMHGQVDCSPGIWQLDCTHLEGKVILVAVHVASGYIEAEVIPAETGQETA          [SEQ ID NO:1470]

CONSENSUS-A     PP?VAKEIVASC?KCQ?KGEAMHGQVDC?PGIWQLDCTHLEGK?ILVAVHVASGYIEAEVIPAETGQETA    746   [SEQ ID NO:1471]
CONSENSUS-B     --v---------d---L-----------S-------------v--------------------------    812
ISOLATE-C       --V-P-----C-D---L----I----N-S-------------I--------------------------
CONSENSUS-D     --V---------D---L-----------S-------------V--------------------------    810
CONSENSUS-O     --------I---P--HI----?-----?S-E?--?----?---I-I-------?F--------------    732
CONSENSUS-U     --I---------D---L-----------S-------------I-I------------------------    812
CONSENSUS-CPZ   --I-----?-?-D--?V----?------S-----V--------V-I-----?--?-----???---??--    569

DESIGNED SEQ    YFLLKLAGRWPVKVIHTDNGSNFTSAAVKAACWWANIKQEFGIPYNPQSQGVVESMNKELKKIIGQVREQ          [SEQ ID NO:2]
MUTATED AAS       I         RT           TT        G Q                              D

ISOLATE-E       YFLLKLAGRWPVKVIHTDNGSNFTSAAVKAACWWANVRQEFGIPYNPQSQGVVESMNKELKKIIGQVREQ          [SEQ ID NO:1470]

CONSENSUS-A     YFILKLAGRWPVKVIHTDNGSNFTSAAVKA?CWWAN??QEFGIPYNPQSQGVVESMNKELKKIIGQVR?Q    812   [SEQ ID NO:1471]
CONSENSUS-B     --l----------t-----------tT---A----GiK-----------------------------D-    882
```

FIGURE 4 (Cont)

```
ISOLATE-C       --L---------R-----------N----A----GIQ-----------------------E-
CONSENSUS-D     --l-----------V---------------A----GIK-----------------------D-   880
CONSENSUS-O     --L----A------------P----??M--A---??IQH--------------A------S--Q---D-   798
CONSENSUS-U     --------------V---------------A-----IK-----------------------E-   882
CONSENSUS-CPZ   --L----?-----T------?---------A----?I-----------------?--?--?----?-D-   631

DESIGNED SEQ    AEHLKTAVQMAVFIHNFKRKGGIGGYSAGERIIDIIATDIQTKELQKQITKIQNFRVYYRDSRDPIWKGP    [SEQ ID NO:2]
MUTATED AAS                     R                   V   S         N L       L

ISOLATE-E       AEHLKTAVQMAVFIHNFKRKGGIGGYSAGERIIDIIATDIQTKELQKQITKIQNFRVYYRDSRDPIWKGP    [SEQ ID NO:1470]

CONSENSUS-A     AEHLKTAVQMAVFIHNFKRKGGIGGYSAGERIIDIIA?DIQTKELQKQI?KIQNFRVYYRDSRDPIWKGP  880  [SEQ ID NO:1471]
CONSENSUS-B     --------------------------------v---t-----------T---------------l----  952
ISOLATE-C       -------------------R----------------S--------N--L--------------------
CONSENSUS-D     ------------------------------------T-----------i--------------------  950
CONSENSUS-O     ----?---------V------------T----?---L-SQ---T------L-?N---------------  865
CONSENSUS-U     ------------------------------------M--T----------T-----------N------  952
CONSENSUS-CPZ   --?------?---?-------------T?-?--?-?-T----??--?--L-?-?---?-------?----  687 vif cds ->
DESIGNED SEQ    AKLLWKGEGAVVIQDNSDIKVVPRRKAKIIRDYGKQMAGDDCVAGRQDED                        [SEQ ID NO:2]
MUTATED AAS                                                A    S ISOLATE-E       AKLLWKGEGAVVIQDNSDIKVVPRRKAKIIRDYGKQMAGDDCVAGRQDED                        [SEQ ID NO:1470]

CONSENSUS-A     AKLLWKGEGAVVIQDNSDIKVVPRRKAKIIRDYGKQMAGDDC?AGRQDED                  929   [SEQ ID NO:1471]
CONSENSUS-B     -----------------------------------------V-s-----                  1002
ISOLATE-C       -----------------------------------------A--V------
CONSENSUS-D     -----------------------V-----------------V-s-----                  1000
CONSENSUS-O     -Q------------KG----------------------T-SM-N--T-SESMEQPGEIP         925
CONSENSUS-U     -----------------------------------------V--G----KHGTAW            1008
CONSENSUS-CPZ   -?------------QGEL-----------------------V-S--N--KHGTAW             742

CONSENSUS A-CPZ FROM LOS ALAMOS HIV SEQUENCE DATABASE
ISOLATE-C FROM GENBANK U46016 HIV-1 SUBTYPE C (ETHIOPIA)
ISOLATE-E FROM GENBANK U51189 HIV-1 SUBTYPE E ISOLATE 93TH253 (THAILAND)
```

FIGURE 4 (Cont)

```
                              <- pol cds
DESIGNED SEQ  MENRW.Q.VMIVWQVDRMRIRTWNSLVKHHMYISKKAKGWFYRHHYESQHPKVSSEVHIPLGE..ARLVI
MUTATED AAs           L           K  K       H   N       FD R              D    I ISOLATE-E     MENRW.Q.VMIVWQVDRMRIRTWNSLVKHHMYISKKAKQWFYRHYHYESQHPKVSSEVHIPLGE..ARLVI CONSENSUS-A   MENRW.Q.VMIVWQVDRMrIRTWNSLVKHHMYVSKKAkGWFYRHHfEsRHpkvsSEVHIPLGd..ARLVV     66
CONSENSUS-B   -----?-.---------------k---------i-g------------Y--t--ri----------..----i    66
ISOLATE-C     MENRW Q VLIVWQVDRMKIRTWNSLVKHHMHISRRANGWVYRHHYDSRHPKVSSEVHIPLGE  ARLII
CONSENSUS-D   -----.-.---------------K---------------?R------Yd-p---I---------E.-----    65
CONSENSUS-O   -----.-.-L----?--QKVKA------Y-K-?-?-??N-?----Y---N-?---?-Y--V??..-??--   54
CONSENSUS-CPZ -????.?.-??---------??-?----?-I???-????-?----Y????--???-?---??????K-?-   34

DESIGNED SEQ  RTYWGLQTGEKDWQLGHGVSIEWRQKRYSTQVDPDLADQLIHLQYFDCFSDSTIRRAILGQIVRRRCEYP
MUTATED AAs   K     H    R  H  Q       L S       G  H    H        A A        HR S    Q
                                                    K              Y

ISOLATE-E     RTYWGLQTGEKDWQLGHGVSIEWRQKRYSTQIDPDLADQLIHLQYFDCFSDSTIRRAILGQVVRRRCEYP

CONSENSUS-A   RTYWGLHTGErDWHLGhGVSIEWrqKRYSTQvDPDLADqLIHLhYFdCFSdSAIRkAILGeiVRPRCEYQ    136
CONSENSUS-B   t---------------g-------k----------------y-----e----n---h--s------       136
ISOLATE-C     KTYWGLQTGERDWHLGHGVSIEWRLRSYNTQVDPGLADHLIHMHYFDCFAESAIRKAILGYRVSPRCDYQ
CONSENSUS-D   k----------?----Q-------KR-------G------MY------E?--------h--S?-----     132
CONSENSUS-O   T-----MP---?E---------?Y-?-K--I--ET--RM------T--T?--?------QR-LTK---?    118
CONSENSUS-CPZ T??-?-??---?---------?--?G?-?-----?T--??--??-?--???-?-?----??????-?-K    76 vpr cds ->
DESIGNED SEQ  SGHNKVGSLQYLAL.KAL...ITPKKIRPPLPSVKKLTEDRWNKPQKIKGHRENHTMNGH
MUTATED AAs   A             T     K K             K E   T R

ISOLATE-E     SGHNKVGSLQYLAL.KAL...TTPKRIRPPLPSVKKLTEDRWNKPQKIKGHRENPTMNGH$

CONSENSUS-A   AGHNKVGSLQYLAL.kAL...VaPtkaKPPLPSvkKLtEDRWnePQKTRGHRGsR?mNgH$             191
CONSENSUS-B   --------------.a--....it-k-i-------?--------K----K-----ht-----           191
ISOLATE-C     AGHNKVGSLQYLAL TAL   IKPKKAKPPLPSVSKLVEDKWNKPQKTRGRRGNHTMNGH
CONSENSUS-D   ---?----------.t--...i--K-I-------R--------K----k--?--HT----             186
CONSENSUS-O   ?--SQ--T--?---.?-V...-K????-------Q?-------K???I-DQL?-?S-----            161
CONSENSUS-CPZ ?--?Q--?--?--??-?-?????????R???--???-------K??R???-?EN?TR---            107
```

FIGURE 5

```
                           <- vif cds                                    LR domain
               /<-      oligomerization           ->/                     /<-
DESIGNED SEQ  MEQ  AP  EDQGPQREPYNEWALELLEELKQEAVRHFPRPWLHNLGQYIYETYGDTWSGVEALIRTLQQL
MUTATED AAs            SS          T              H         G H          E        I
                                                  N         S
ISOLATE-E     MEQ  AP  EDQGPQREPYNEWALELLEELKQEAVRHFPRPWLHNLGQYIYETYGDTWSGVEALIRTLQQL CONSENSUS-A   ME?..AP.EDQGPQREP??E??LELLEELKHE?VRHFPR?WLHGLGQHIY?TYGDTWEGV?AIIRILQQL     58
CONSENSUS-B   --q??--?---------yN-Wt--------?-A------i---?------E------a--E---------   65
ISOLATE-C     MEQ  AP  EDQSSQREPYNEWTLELLEELKNEAVRHFPRPWLHGLGQYIYNNYGDTWEGVEAIIRILQQL
CONSENSUS-D   --Q..---.---------YN-Wt--------S-A------I---S---?--E------?--E-?-------   64
CONSENSUS-O   --Q..---.-n---a---fN-Wt--------?-A------p---a---y--E---------m---------   66
CONSENSUS-U   --Q..---.A--------HN-WT--------Q-A------I---S------E---------E----S----   67
CONSENSUS-CPZ --Q..---.?-?--?------W---T---?-N-A-----?P?-????-???-?-???????-??????-??   33

LR domain ->/  tat cds ->
DESIGNED SEQ  MFIH FRIGCQHSRIGIL    RQRRA RNGASRS
MUTATED AAs   L V      R      I          G    S
                             T
ISOLATE-E     MFIH FRIGCQHSRIGIL    RQRRA RNGASRS CONSENSUS-A   LF?H.FRIGCQHSRIGII...?GRHG.RNGA?RS$                                       84
CONSENSUS-B   --i-?-----r------t...-q--a?----S---                                       93
ISOLATE-C     LFVH FRIGCQHSRIGIF    AREKRQEWSW
CONSENSUS-D   --I-.-----------t...RQ--A.---SS--                                         93
CONSENSUS-O   --t-.y-----------????-rg--r---SS--                                        94
CONSENSUS-U   --I-.-----------T...RQ--A.---SS--                                         96
CONSENSUS-CPZ ??I-.????-??-----L...PQ--R.S--SN--                                        54
```

FIGURE 6

```
                                    intramolecular     3'sj    3'sj
                                    disulfide bonding   \/      \/
                                    |                 | rev cds. ->/<- nls ->/

DESIGNED SEQ   MDPVDPNLEPWNHPGSQPTTACSKCYCKKCCFHCQLCFLKKGLGISHGRKKR   KQRRGAPQSRKDHQYP
MUTATED AAs         K       K       K     T       Y   V   T       Y     R   R   SE
                                          N                                      Q
ISOLATE-E      MELVDPNLEPWNHPGSQPTTACSKCYCKKCCWHCQLCFLKKGLGISHGRKKR   KHRRGTPQSRKDHQYP

CONSENSUS-A    M?PVDPnLEPWnHPGSqPtTaCskCYCK?CCwHCqlCFLnKGLGISYGrKKR..r?RRgtPQs?kDhQnp    64
CONSENSUS-B    -e----r----k------k---tn----k--f---v--tt------------..-Q--ra--dSqt--vs    68
CONSENSUS-C    ------?-----------K---t-----k-sY--lV--qt------------...-q--sa-?-SE-----    65
CONSENSUS-D    -d---------------?-p-N--h--K--Y---v--it-------------..-Q--rp--ggQa--?-    66
CONSENSUS-F    -EL-----D----------P-T-----R--F---W--TT-------------.KQ-HR----SQI--DL     68
CONSENSUS-O    -D----E?P--H-----?-Q?P-NN----R--Y--YV--??------?-----...-???AAA--P-?KD-    55
CONSENSUS-U    -D----K-----------K---T-----K--Y--PV----------------..-P--RS--NSE-----    68
CONSENSUS-CPZ  -D-?-????--?--???-?-?-NN-------Y--??--TK-----------?-???---T????S?NN-D?   45 exon \/ exon

DESIGNED SEQ   IPEQPLPQTRGGNPTDPKESKKEVASKTETDPCD
MUTATED AAs     S      SPD   GE    KE A    F

ISOLATE-E      IPEQPLPIIRGGNPTDPKESKKEVASKAETDPCD

CONSENSUS-A    ipKQplPqtqg??ptgpkESkKkVeSKteTDrf?$                  95
CONSENSUS-B    Ls---?s-pr-D.-----------rE----P?d?                   99
CONSENSUS-C    -s-------r-d.----E------------p-D-                   98
CONSENSUS-D    -----SS-pR-d-------?-------A--p-Dw$                  99
CONSENSUS-F    V----IS-AR-N.-----?---E----A??-P?--$                 96
CONSENSUS-O    V-?-S???-?RK.Q?RQE-QE??--K??GP?G?P????SC??CTR?S?Q$    83
CONSENSUS-U    ----S--H-RV.S---E----E----A-----D-                   101
CONSENSUS-CPZ  ??-??-?????-.?????K??-?-??--?????-?                   52
```

FIGURE 7

```
                                                   high-affinity
                                                   binding site
                                                        nls
             \/ 3' sj              exon \/ exon   /<-              ->/
DESIGNED SEQ  MAGRSGSTDE ELL RAVRIINILYQSNPYPSSEG TRQTRKNRRRRWRARQRQIRAISERILSTCLGRS
MUTATED AAs              D      K I  K            S  A R           E  .HS  W   NF     P
                         N
ISOLATE-E     MAGRSGSTDE ELL RAVRIINILYQSNPYPSSEGGTRQTRKNRRRRWRARQRQIRAISERILSTCLGRS CONSENSUS-A   MAgRSG?sDE.eLL.KAiRIIKiLYQSNPyPkPkG.SRQARKNRRRRWRARQRQIDS1SeRILStCLGRP    66
CONSENSUS-B   ------d---.----tV-l--f------p-s-e-.T----R-------e-----r-i--w----y---s    67
ISOLATE-C     MAGRSGDSDE ELL KAVRIIKILYQSNPYPTPEG TRQARRNRRRRWRARQRQIHTLSERILSNPLGRP
CONSENSUS-F   ------N-?T.----R-?-Y-------------E-.T----R-----------?-R??-?----S-----    61
CONSENSUS-O   -----E-.-..Q?-?Q--Q---------?-?-?-.---N----------R--A-V-?-A?-?-A-VVHG?    56
CONSENSUS-U   ------DA--.---.RVV------------P-E-.T--T---------------RAI---F-------S    67
CONSENSUS-CPZ ----?E-??????-??-VK-------?----?-?-.?-?--R-?----??--?-??????-V-?-??---    41

Leu-rich
              effector domain
              /<-      ->/
DESIGNED SEQ  AEPVPLQLPPLERLHLDCSEDCGTSGTQQSQGTETGVGRPQISGESSVILGPGTKN
MUTATED AAs                N      SD                 N  L    AV S
                                                     S
ISOLATE-E     TEPVPLQLPPLERLHLDCSEDCGTSGTQQSQGTETGVGRPQISGESSVILGPGTKN CONSENSUS-A   AEPVPLQLPPlERLhLDCsEdcgTSgTQq?qg?etGVGrpQvsVEssavLGSGTkn                   120
CONSENSUS-B   --------------t---?---------......?---s--il---p---e----E$                 115
ISOLATE-C     AEPVPLQLPPLERLNLDCSEDSDTSGTQQSQGTTEGVGNP PREMATURE TRUNCATED
CONSENSUS-F   E---------?---?IN?--?-E.Q-A?E......---S--T-G--H--------E$                 105
CONSENSUS-O   Q?NN?VD-----Q-?IRDP-?D?L????TVDPRAEDN$CL-NLCSCNT????????N$                 95
CONSENSUS-U   ----------I---C-----G--------P--T-----S-PI-G---TI------E$                 123
CONSENSUS-CPZ PK-GD-E---E-DK-S-Q-V-TTQDV--SNTSQPQ-AT-ETVPAGGNYSI--K-A--                  97
```

FIGURE 8

```
                                                                      env cds ->
                                                                 phos |   | phos DESIGNED SEQ MTPL     EIIAIVAFIVALIIAIVVWTIAYI EYRKLLRQR    RIDRL IKRTRERA EDSGNES
MUTATED AAs             L       L         VF   K  K        K     E I CONSENSUS-A  mtPL???  eIcAIvGLiVALILAIVVWTIVgI.eyKkllkqr.......Kidrl?ikRIrERA.EDSgNES  57
CONSENSUS-B  -qs-     q-?---a-v--a-i--------f-?--r-i-R--......?-------d------.-------  56
ISOLATE-C    MVDLLAKVDYRIVIVAFIVALIIAIVVWTIAYI EYRKLLRQR    RIDRL IKRTRERA EDSGNES
CONSENSUS-D  -Q--     v-l---A-v----i--------f-.-crr-kr--........---w-.-d------?-------  57
CONSENSUS-F  -S??     LAIS?TA------I--------?Y-.--R---R--.........--N---YE?--?--.-------  51
CONSENSUS-O  -H??     ?LL-?I??SAL??INV??-?..F?..LR?Y-?-??QDR?E?E-LER.LR--?-IR.D--DY--  42
CONSENSUS-U  -Q--     T-T-----V--F-A-----S--Y-.--R-IR--K.......-----.LD------.-------  57
CONSENSUS-CPZ --??    ?????L???????W?-CI???I????-??YK???....??????-?.??I?????.??????-  14

DESIGNED SEQ EGDTEE LSTM    VDM GNYDLGVDNNL
MUTATED AAs      R    AL

CONSENSUS-A  ?GDT?E.L?kL....VEM.GnydlgvdnNL$                                           78
CONSENSUS-B  e--qe-.-sa-????---?-H?apwdvdD--                                           79
ISOLATE-C    .DGDTEE LSTM    VDM GNLRLLDVNDL
CONSENSUS-D  E--rE-.-sa-....---.-HhAPwd?Ddm-                                           80
CONSENSUS-F  E--AE-.-A?-.....G--.-PFIP-DI?---                                          73
CONSENSUS-O  N?EE-QEVM?-.....??SH-F?NPM.FE??                                           59
CONSENSUS-U  D---E-.-ST-....M--.-YEYILDND---                                           81
CONSENSUS-CPZ -?EE--??-??????????FANP?.????DE                                          23
```

FIGURE 9

```
                                       <- vpU cds
                                 signal peptide / gp120
                                           *
DESIGNED SEQ   MRVKETQMNWPNL WK          W GTLILGLVIIC SA SD NLWVTVYYGVPVWRDADTTLFCAS
MUTATED AAs                  R             M    M M      E                E T CONSENSUS-A     Mrvmgiq?nyq?l.wr??....??W.gtmilg??iIc.na??e.?lWVtVyYGVPVWkdaeTTLfcAS    49
CONSENSUS-B   ??---k--rk---h-?----????---.---l--mlm--.s----.--------------e-t-------    53
CONSENSUS-C     ---r--?r-w-qw.-i........-.-ILGFwmlm--.-v--g.n-------------e-k-------    53
CONSENSUS-D     ---r?-er---h-.----????---.---L--mLM--.sv.a??--------------E-t-------    52
CONSENSUS-E     ---Ket-m-wpn-.-k--....---.--l---lv---?s-.Sd.N------------r--d-------    55
CONSENSUS-F     -?-R-M-R-W-H-.GK........-.-LLF--iL---.--.--.n-------------e-T-------    53
CONSENSUS-G     -?-k---r-W-H-.-k........-.--L---LV---.s-.sn.n------------E--D-------    54
CONSENSUS-O     -t-tMKaM?KrNr.Kl........-?lylamALi-P-.LS.-??Q-YA---s-----E--?Pv-----    51
CONSENSUS-U     -?-?E?-R-??-?.-?........-.???-----?--.?-.-??-?----------------------    36
CONSENSUS-CPZ   -??????-???-?.??--?.....??????-?--???.?T.--.-??---?------??-?P?----?    19

*                ^^^                                *

DESIGNED SEQ DAKAHETEVHNVW ATHACVPTDPNPQEIHLE NVTENFNMWKNNMVEQMQEDVISLWD QSLKPCVKLT
MUTATED AAs      YD                     VV                D  D  H  I

CONSENSUS-A    dAkAydtE?HNVW?aTHaCVPTDPnPqEi?le.NVTE?FnmwkNnMVeQmheDiiSLWD.qSLkPCvkLt   113
CONSENSUS-B    --------v----.---------------vv-??----n--------------------.----------   119
CONSENSUS-C    -----e?-v----.---------------mv--.----n------d--d-----------.----------   119
CONSENSUS-D    ---s-k?-a--i-.------------------.----N-----------------------.----------   117
CONSENSUS-E    ----He--v----.------------------.----n------------q--v-----?----------   121
CONSENSUS-F    ---S-Ek-v----.---------------Vv--.----n-d----------T-------.----------   120
CONSENSUS-G    -----s--s----.------------------.----n----------------------.E---------   120
CONSENSUS-O    --NLTS--q--I-.-sQ-------?-?-yp-?.---d---I---Y--d-----------.-------qM-   114
CONSENSUS-U    ---?-??------.--------?--?---?--?.-----------?--------------.?---------    91
CONSENSUS-CPZ ?-???S-----?-.--??---?--?-??V--?.-???---??--?--??-?--???-??.--?-------    56

*    *              ^^^               ^^^

DESIGNED SEQ PLCVTLNCTNANLINVN  .     HYPERVARIABLE REGIONS 1/2
MUTATED AAs

CONSENSUS-A    PLCVTL?C.??????????n?t??????????n?t???????n?????...????????.........m   126
CONSENSUS-B    ------n-.td---------?-?-------------------------???---------??...????-   133
CONSENSUS-C    ------n-.----......--?----....-------------t---?..-------........??   132
CONSENSUS-D    ------n-.t----------?--------...--------------t---?...------?????????   131
CONSENSUS-E    ------n-.tna-----...-l---.---nv--i-nvsniig-it....................?????   150
CONSENSUS-F    ------n-?t-a--......-a---------t-?-?-q--.........................?tLkE   139
CONSENSUS-G    ------n-.t----......-V--t--......?-?........NcT--?en--nNstv-........???   143
CONSENSUS-O    F---QMn-.td-----...-------l--...----..............................   129
CONSENSUS-U    ------n-.t---.........----............---e-..............------..........   105
CONSENSUS-CPZ -?-???--.---------.................?-?-----.................-------P????..???    60

^*^ ^^^

DESIGNED SEQ            HYPERVARIABLE REGIONS 1/2
MUTATED AAs

CONSENSUS-A    ?..?e.....ikNCsfNmTtelrdkkqkvysLfYrlDvVqi????????n??????....n?????????   160
CONSENSUS-B    e??g-?????-------i--si---v--e-a---k----p-d-------?------????----------   169
CONSENSUS-C    -?.--.....-------a---?--------A------i-pl-----.---------......--s--.----   166
CONSENSUS-D    -?.-g.....m------i--?v----kq-ha---k--------------------------....--t--.----   165
CONSENSUS-E    -..d-.....Vr----------------hA---k--i---------.---s----?...?--..----   185
CONSENSUS-F    eP.ga.....-Q---------v---Q?--Ha------I-p-s---..--ns---....??--..-----   177
CONSENSUS-G    -..e-.....m------i---i----ktE-A---k----p-n---...-?ss-.........----.---sd   182
CONSENSUS-O    ...n-??...m-?-?--V--V-k---E-KQA---Vs-L?k?N-ts--.--T---...............m   164
CONSENSUS-U    -??-?.....-------i---?----kt?-a---k----P-n---....-n---......?--......-   137
CONSENSUS-CPZ -??-?.....???-?--??-???---??????--??-????--........--..........--T.....--    73

*^^^     *            *          *       ^^^  * ^^^    *

DESIGNED SEQ YRLINCNTSVIKQACPKVSFDPIPIHYCAPAGYAILKCNDKNFNGTGPCKNVSSVQCTHG IKPVVSTQL
MUTATED AAs        S    A T    IT E            F      N K       T   T           R
                                                          T
```

FIGURE 10

```
CONSENSUS-D      ------------------t-------------------n--k-------------------.-r------        234
CONSENSUS-E      --------V-K-----i--D-------t---y-----N--n-----------S------.---------        254
CONSENSUS-F      ----?----T---------Wd----------Y-----N--k-----------------.---------        245
CONSENSUS-G      -------v-T-K------n-d-------------r--n--------------------.---------        251
CONSENSUS-O      -?-t---STt-?-----------------y--F--N?T------1-?-itV-T----.---T-----         228
CONSENSUS-U      ---------?-k-------------------------n--K-----------------.---------        205
CONSENSUS-CPZ    -????---T?---?-?-??-------------?----?---?D-?-?-?-?---?-H----.-?-?-?-?-     120
                                                      <- V3 neutralization loop
                  ^^^              ^^^              ^*^  ^^^

DESIGNED SEQ   LLNGSLAEE  EIIIRSENLTNNAKTIIVHLNESVEINCTRP NNNTR K       HYPERVARIABLE REGION 3/4/5
MUTATED AAs       VV          F D V            Q K V         S
                                                             T

CONSENSUS-A      LLnGSLAe???v?irSenitnNaktiiVql??pV?InCtRP.nnntr.ks???vri???gpGq??afya.        279
CONSENSUS-B      --------e.e-v-----f-d---------nes-e------?------.ih-------r..---t.           296
CONSENSUS-C      ---------eii----l---v-----h-n-s-e-v----.------..--...i--...-----t---.       291
CONSENSUS-D      -------E.EiI-----l-----?-----nes--------?y?----.qr..-tp-....?--...-l-t?     288
CONSENSUS-E      --------e.eIi-----L---------h-NKs-e------.s-----.t-....it-.........v--r.    312
CONSENSUS-F      --------e.dii----q--sd-------h-Nes-q------.------.------..I?-....-r..----.  302
CONSENSUS-G      --------e.eI------?-d---v-----nksie-?----.------.--...I?f....-----.-----.   305
CONSENSUS-H      -.-------?---D-T-N----K----------.------.?----.I?-...-?--...?-?-.           39
CONSENSUS-O      I---T-Skg.kIr-Mgk--?dsg-N---T-N-?i-mt-e---.g-?-v.Qe...i?-..--.m..--W-S.     279
CONSENSUS-U      --------E.E-i---?----d---------net-k------?-----.?--...?--.-----..v---.     261
CONSENSUS-CPZ    -?--????---?-?????K?????V?????-E??-??-?---.G-?-?.??...?Q-.....--M..T--N.    142

V3 neutralization loop ->                                         CD4
                                        *^^^     ^^^              ^^^         ^ ^^ |

DESIGNED SEQ                HYPERVARIABLE REGION 3/4/5
MUTATED AAs

CONSENSUS-A      tgdi.....iG.dirqAhCnvsr?eWn?tlq?V....a?qLr?...?f???nkt....??iiF?n.ssGGD      320
CONSENSUS-B      --?-???..---.---------i--ak--n--kqi....v-k--e??q-.------.----v-nq?-----     342
CONSENSUS-C      ----.......--.---------I-?-k--e-:---....?kK-ae..h-p-----.......-k--?.-----  334
CONSENSUS-D      -?r????..?-?---------i-?a?--k---q-.....--k-gd?.ll.-----.....t---kp.-----    331
CONSENSUS-E      ----.......--.-----k-y-EINgTk--e?-kq-.....tek-ke..H---.n---.....---qP?p---- 360
CONSENSUS-F      --?-...........-k------gtq-----e-----.?a?-ks..h--.--?-.......--k-ns.----    344
CONSENSUS-G      ----.......--.------------?-?em--n--.....?-?-?-..i------?...?---t-ns.-a--- 344
CONSENSUS-H      ?-?-.........----?-?--I??-?-?-?-?---.....?---?-.H?..--??.----?-P.------     65
CONSENSUS-O      M-.1???n?k???s-?-Y-?YnaTd-?ka-kqt....-eRYLe..Lv...-?-????vtm?-n?s-?---      321
CONSENSUS-U      ----.......--.---------i--t?--n---q-.....------k..y-..n-?-......--?-ns?---- 306
CONSENSUS-CPZ    ?E??.....-?-.-T-?-?-??N?T?-?-???-??????-???-....-?...-?-....?A-???-?.???--  157

| CD4    *      *^^^     ^^^              ^^^         ^^^       ^^^

DESIGNED SEQ              HYPERVARIABLE REGION 3/4/5
MUTATED AAs

CONSENSUS-A      lEitthsFnCggef?FYCnts?lF.nstW???????....n?t.??????.??n?t????...???sndtI      355
CONSENSUS-B      p--vm---------.------tq--.-----------????---?------?---------??---????-     374
CONSENSUS-C      ----------r---.---------.----y-----p-...?-g-?------?-.--?...??---????-      366
CONSENSUS-D      p-------------.---------.---------------????--??---.--?.......--??---????- 361
CONSENSUS-E      ----m-h---r---.------t----.n-cig-.........-e-m.....-gc..-g-.........????-   398
CONSENSUS-F      ----m-----r---.---------.--?-?------......--?-----.?-----....---???--       372
CONSENSUS-G      ----------r---.------g--?-?s?----.........-n??-----?.----?---.....--????-   373
CONSENSUS-H      ?--??-?---?---.-----?K--.-----------........--??---.N--?..-G-...........??- 92
CONSENSUS-O      ?-v-hlh----H---.---------m-..-y-Fsc-----????---?-----?-----n-......?-g-?    356
CONSENSUS-U      ?-----t--------.---------.--?----.......-----?d-...-?.-------.....-????-    336
CONSENSUS-CPZ    P-V??-?---?---.---???-?-.????---........?I-..............:........-G??      175

*        CD4 |                          *   ^^^          | CD4  ^^^

DESIGNED SEQ                  HYPERVARIABLE REGION 3/4/5
MUTATED AAs

CONSENSUS-A      t..lq.CrI.kqIvnm.wQrvgq.AmYapPIq.g?irt?sNITGllLTRDGg??....nns??...????       401
CONSENSUS-B      -??-p.----.---i---.--e--k.-------?.-q---s---------------????-??--?.?----    419
CONSENSUS-C      -...-p.----.---i---.--e--r?-------?.-n-t-k--------?------???.-?t--???----   411
CONSENSUS-D      -...-p.----.---i--?--?--k.-------e.---?-s-----------------?....?--....?---- 405
```

```
DESIGNED SEQ    TFRPGGGDIKDNWRSELYKYKVVKIEPLGVAPTR AKRRVV    EREKRA  VG IGAMIFGFLGA
MUTATED AAs        I   NMR            E K  I   K           Q            L  FL

CONSENSUS-A     ?netFrPgGgdmrdNWrsELYkYKvVkiePlGvaPtr.akrRVV....eREKRA??vg.lGavflgflGa    462
CONSENSUS-B     -t-i--------------------------k.------....q-----..--?i--m------           480
CONSENSUS-C     -?------------------e-k--------?.------??..------..---?i---------          470
CONSENSUS-D     -----------------------r--------?.------....------..I-.---m------          465
CONSENSUS-E     -------NiK-----------Q-----i------.------..-------.---I--Mif-----          508
CONSENSUS-F     -?-------n-k----------e----------.---q--....k---------.?--l-------         478
CONSENSUS-G     ------------------------k--------.------....G-----..--.?---------          481
CONSENSUS-H     -?V--------------------??----?---?..-?----..?-----..--.-?---------         187
CONSENSUS-O     --?-1--?----k-I--T--f-----rvK-FS----ki-RP?Igt?t?H------..---ML---v-S-      462
CONSENSUS-U     -?--------------------------.??----....?-----.---.M--?-------              435
CONSENSUS-CPZ   -?????-??????-?--?--??-?--?-?--S----???R??????.?-Q--?.-?-.?-??---?-?-     227

DESIGNED SEQ    AGSTMGAASITLTVQARQLLSGIVQQQSNLLRAIEAQQHLLQLTVWGIKQLQARVLAVERYLKD QKFLG
MUTATED AAs              M     L          N         M                  I        QL

CONSENSUS-A     AGSTmGAaSiTLTvQarqLlSGIVqqQsNllrAIeaQqhlL

```
CONSENSUS-O    q?E.agT-G-TG-g--.-e--p-Wtp-Pq---?-LYT---TII-Wt--L-SNLaSg.I..........qk        702
CONSENSUS-U    --G.----G-T-----.-E-NN--V---N-------E------I--------L---.V.....-KG-R..         685
CONSENSUS-CPZ  Q?-.?????E-?-?--.??--?-???-??-???-?-----N-GIW--QS-TSLACN.V.W-##LKT---L         398
                                             <- rev cds DESIGNED SEQ  SLRGLRRG       WEALKYL WNLLQYWGQELKISAVSLLNATAIAVAEGTDRVIEVAQRAGRAILHI
MUTATED AAs     K Q                  G   WG    L    L  N I              GW   I   V   W    N

CONSENSUS-

```
DESIGNED SEQ  MGGKWSKSSLVGWPEVRERIRQT              PPAAEGVGAVSQD      LDKHGAITSSNTPA
MUTATED AAs          C P   A      RA              A         AR       Y L      A

ISOLATE-E     MGGKWSKSSIVGWPQVRERIKQT              PPAAEGVGAVSQD      LDKHGAVTSSNM

CONSENSUS-A   MGGKWSKsSiVgWPeVrkRmRqT..............?PtAAkGVGAvSQD.....LDKhGAiTSSNt??        48
CONSENSUS-B   -------?-??---?--e---ra?????????????-Ep--d------r-.....-e----------aa         46
ISOLATE-C     MGGTMSKCSPVGWPAIRERIRRA              APAAEGVGAASRD      LDKYGALTSSNTPA
CONSENSUS-D   --------------AI-E-I-r-?????..........dP--D------R-.....-E----------as        50
CONSENSUS-O   --NA??-?KF?--??--?---R?.........????P?-?PC-P---??-RE.....-A?R-G-?--H-PQ       38
CONSENSUS-U   --?----????---??-E-I-?-???............-P???----?---?????-?-?--??--??A-        31

\vskip6pt
                     *     SH3-binding  |  | ·|   | SH3-binding

DESIGNED SEQ  NNADCVWLK AQE   E   EG VGFPVRPQVPLRPMTYKGAFDLSFFLKEKGGLEGLVYSKKRQEILDLWV
MUTATED AAs        P A   E        E                AV   L          D I Q    D

ISOLATE-E     NNADCVWLR AQE   E   EG VGFPVRPQVPLRPMTYKGAFDLSFFLKEKGGLEGLVYSKKRQEILDLWV

CONSENSUS-A   tnpsCaWLE?Aqe?.d..e?.VGFPVRPQVPLRPMTYKgAvDLShFLKEKGGLDGLIyS?kRQEILDLWV         110
CONSENSUS-B   --ad-----.----.e??-e?-----------------a-?-----------e---?-q---d------         108
ISOLATE-C     NNPDCAWLE AQEE  E   EE VGFPVRPQVPLRPMTYKAAFDLSFLFLKEKGGLEGLIYSKKRQEILDLWV
CONSENSUS-D   --ad-----.----.ES.-E.-----------------e------------E---W-K----------         115
CONSENSUS-O   N-AAL-F-?.SH?..?..--.-----?---------?-?-F---F--------?-----H--A------?         93
CONSENSUS-U   N-??-???-.??-..E?.-E.-----------------?---F---?------------??--------         83

\vskip6pt
                                       SH3-binding
                                 *       |  |

DESIGNED SEQ  YHTQGFFPDWHNYTPGPGIRY PLTFGWCFKLVPVDPREVE EINKGENNCLLHPMSQHGMEDEEREVLI
MUTATED AAs     N   Y   Q    T                S     A E    ICL     D   K
                            V

ISOLATE-E     YHTQGFFPDWHNYTPGPGIRY PLCFGWCFKLVPVDPREVE EDNKGENNCLLHPMSQHGIEDEERVLI

CONSENSUS-A   YnTQGfFPDWQNYTPGPGtRf.PLTFGWCfKLVPvDPaEVE.eat?GEnNSLLHPICQHGmdDe?revLm        176
CONSENSUS-B   -h---y--------?-y?---------e-ek--.--ne---------msl-----pE----?                174
ISOLATE-C     YNTQGFFPDWQNYTPGPGVRY PLTFGWCFKLVPVDPSEVE EINEGENNCLLHPASLHGMEDEDREVLK
CONSENSUS-D   -----I------------I-Y.--------e------g----.---E--t-c----?-----E-pE-q--k       182
CONSENSUS-O   -?---------?------?--.------L------S?E-A-RLGNT?-?A?----A-?--?E-?H?-I-?       150
CONSENSUS-U   -H---?----?-------?-?.--?---------??-?---.---N-----C----?S----?-?E---?        138

\vskip6pt

DESIGNED SEQ  WKFDSRLARRHIARELRPEFY KDC
MUTATED AAs        H L   M    H   Y

ISOLATE-E     WKFDSALARRHIARELRPEFY KDC

CONSENSUS-A   WkFDSrLAlkHrA?ElHPEfY.KDC$                                                    199
CONSENSUS-B   -r------fh-m-r-----y-.---?TSMCLQGTFRWGISREARLGGTGEWRALRCCI                    230
ISOLATE-C     WKFDSHLARRHMARELHPEYY KDC
CONSENSUS-D   -R-N----fE-K-R-m-----.---                                                     206
CONSENSUS-O   -?--RS-G?T-?--??---LF?-?                                                      166
CONSENSUS-U   -----S--??-?-R-?---?-.---                                                     157
```

FIGURE 11

GAG OVERLAPPING SEGMENTS

Segment 1

```
  M   G   A   R   A   S   V   L   S   G   G   K   L   D   A   W   E   K   I   R   L   R   P   G   G   K   K   K   Y   K
                      [I]                      R                                                                        R
                      E
 atg ggc gcc agg gcc agc rtc ctc agm ggc ggc rag ctg gac gcc agg cct gaa aag att agg cct gaa aag aaa aag tat arg
```

Segment 2

```
  W   E   K   I   R   L   R   P   G   G   K   K   K   Y   K   M   K   H   L   V   W   A   S   R   E   L   E   R   F   A
                                              R   L   I
 tgg gag aaa atc aga ctg aga ccc gga ggc aaa aag tac ara mtg gtg tgg gcc tcc agg gaa ctg gaa agg ttt gcc
```

Segment 3

```
  M   K   H   L   V   W   A   S   R   E   L   E   R   F   A   L   N   P   G   L   L   E   T   A   E   G   C   Q   Q   I
  L   I                                                                      S                                          K
 mtg aag cat mtc gtc tgg gct agc aga gag ctc gag aga ttc gct ctg aat ccc gag ctc ctc gag aca kcc gaa ggc tgt mag caa att
```

Segment 4

```
  L   N   P   G   L   L   E   T   A   E   G   C   Q   Q   I   L   E   Q   L   Q   S   A   L   K   T   G   S   E   E   L
                  S                              K                              G                  P                     T
                                                                                                   Q
 ctc aac cct rgc ctc ctg gaa acc kct gag gga tgt maa cag atc ctg gra cag ctc gag yct gcc ctc mag aca ggc wcc gaa gag ctc
```

Segment 5

```
  L   E   Q   L   Q   S   A   L   K   T   G   S   E   E   L   K   S   L   Y   N   T   I   A   T   L   W   C   V   H   Q
      G                  P                  T                              R                   F
                         Q                                                                     V
 ctc grg caa ctg caa yct gct ctg maa acc gga wca gag gaa ctg twt aac aca rtc gct acc ctc tgg tgt gtg cat cag
```

Segment 6

```
  K   S   L   Y   N   T   I   A   T   L   W   C   V   H   Q   R   I   E   V   K   D   T   K   E   A   L   D   K   I   E
  R                     F                                                          D                   R
                        V
 ara agc ctc twc aat acc rtc gcc aca ctg tgg tgc gtc cac caa agg att gas gtc arg gac aca aag gaa gcc ctc gac aaa atc gaa
```

FIGURE 12

```
R  I  E  V  K  D  T  K  E  A  L  D  K  I  E  E  E  Q  K  K  S  Q  Q  K  T  Q  Q  A  A  A  A    Segment 7
   D                 R
aga atc gaw gtg ara gat acc aaa gag gct ctg gat aag att gag gwg caa aas aaa agc mag caa aca caa cag gct gcc gct E  E  Q  K  K  S  Q  Q  K  T  Q  Q  A  A  A  A  D  T  G  S  S  K  V  S  Q  N  Y  P  I  V     Segment 8
      V        N        K                                                   Q
gaa gwa cag aaw aag tcc maa cag gcc gcc gat aca ggc gat aca ggc arc tcc agc mag gtc agc caa aac tat ccc att gtg D  T  G  S  S  K  V  S  Q  N  Y  P  I  V  Q  N  A  Q  G  Q  M  V  H  Q  P  L  S  P  R        Segment 9
      N           Q                             L                             A  I
gac acc gga art agc tcc maa gtg tcc cag aat tac cct atc gtc cag aat gcc caa ggc caa atg gtc cac caa scc mtc tcc ccc aga Q  N  A  Q  G  Q  M  V  H  Q  P  L  S  P  R  T  L  N  A  W  V  K  V  I  E  E  K  G  F  N     Segment 10
         L                       A  I                          V                       A  S
caa aac syc cag gga cag atg gtg cat cag act-mtt agc cct agg acc ctc aac gct tgg gtc aag gtc rtc gaa gag aaa gsc ttt arc T  L  N  A  W  V  K  V  I  E  E  K  G  F  N  P  E  V  I  P  M  F  S  A  L  S  E  G  A  T     Segment 11
                     V                    A  S                                          T
aca ctg aat gcc tgg gtg aaa gtg rtt gag gaa aag ttc art ccc gaa gtg att ccc atg ttt wcc gct ctg tcc gag gga gcc aca
```

```
P   E   V   I   P   M   F   S   A   L   S   E   G   A   T   P   Q   D   L   N   M   M   L   N   I   V   G   G   H   Q    Segment 12
                                        T                                           T               T
cct gag gtc atc cct atg ttc wca gcc ctc agc gaa ggc gct acc ccc caa gac ctg aat ayg atg ctc aac ayc gtc ggc gga cac caa P   Q   D   L   N   M   M   L   N   I   V   G   G   H   Q   A   A   M   Q   M   L   K   E   T   I   N   E   E   A   A    Segment 13
            T                       T                                                       D
cct cag gat ctc aag atg ayg ctg aac ayt gtg gga ggc cat cag gct caa atg ctg aaa gas aca atc aat gag gaa gcc gct A   A   M   Q   M   L   K   E   T   I   N   E   E   A   A   E   W   D   R   V   H   P   V   H   A   G   P   I   P   P    Segment 14
                        D                                               I                                   V   A
gct gcc atg cag atg ctc aag gaw acc att aac gaa gag gct gcc gag tgg gac aga rtc cat ccc gtc cat gcc gga ccc rtt acc cct E   W   D   R   V   H   P   V   H   A   G   P   I   P   P   G   Q   M   R   E   P   R   G   S   D   I   A   G   T   T    Segment 15
                    I                           V   A                       I
gaa tgg gat agg rtt cac cct gtg cac gct gcc cct ctc act ccc ggc caa atg aga gag cct agg gga agc gat atc gct ggc aca acc G   Q   M   R   E   P   R   G   S   D   I   A   G   T   T   S   T   L   Q   E   Q   I   G   W   M   T   N   P   P    Segment 16
                                            A                                                           A
                                                                                                        S
gga cag atr agg gaa ccc aga ggc tcc gac att gcc gga acc aca agc aca ctg caa gag caa atc gaa tgg atg aca arc aat ccc cct S   T   L   Q   E   Q   I   G   W   M   T   N   N   P   P   I   P   P   V   G   D   I   Y   K   R   W   I   I   L   G   L    Segment 17
                                        A                                           V                       E
                                        S
tcc acc ctc cag gaa cag att gsc tgg atg aca art aac cct ccc rtc cct gtc gga gas att tac aaa agg tgg att atc ctc ggc ctg
```

```
                                                                                                        Segment 18
I P V G D I Y K R W I I L G L N K I V R M Y Q P V S I L D I
V                                 E                                     S
rtt ccc gtg ggc gaw atc tat aag aga tgg atc att ctg gga ctc aac aaa atc gtc agc att ctg gat atc
                                                                                                        Segment 19
N K I V R M Y Q P V S I L D I R Q G P K E P F R D Y V D R F
                          S                       K
aat aag att gtc agg atg tac yma cct ctc atc gac att arg caa ggc cct aag gaa ccc ttt agg gat tac gtc gac aga ttc
                                                                                                        Segment 20
R Q G P K E P F R D Y V D R F Y K T L R A E Q A T Q E V K N
K                                       F                             S   D
ara cag gga ccc aaa gag cct ttc aga gac tat gtg gat agg ttt twc aaa acc ctc agg gct gag caa gcc wca cag gaw gtg aaa aac
                                                                                                        Segment 21
Y K T L R A E Q A T Q E V K N W M T E T L L V Q N A N P D C
F                       S   D                             D
twt aag aca ctg aga gcc gaa cag gct wcc gas gtc aaa aat tgg atg acc gas aca ctg ctc gtg caa aac gct aac cct gac tgt
                                                                                                        Segment 22
W M T E T L L V Q N A N P D C K S I L K A L G T A T L E E
                          D                           T           R         P   S
tgg atg aca gaw acc ctc ctg gtc cag aat gcc aat ccc gat tgc aag wcc atc ctc arg gct ctg gga gcc wca ctg gaa gag
                                                                                                        Segment 23
K S I L K A L G T A T L E E M M T A C Q G V G G P S H K A
    T       R       P   S                                                                   G
aaa wca att ctg ara gcc ctc ggc mca ggc gct wcc ctc gag gaa atg atg aca gcc tgt cag gga gtg gga ggc cct rgc cat aag gct
```

FIGURE 12 (Cont)

```
                                                                                                           Segment 24
M M T A C Q G V G G P S H K A R V L A E A M S Q A T H A N I
                  G                                   V N N
atg atg gct tgc caa ggc gtc ggc gga ccc rgt cac aaa gcc agg gtc ctg gca gag gct atg tcc cag gyg amc mac gct aac att Segment 25
R V L A E A M S Q A T H A N I M M Q R G N F K G Q K R I I K
                    V N N                           R P   V
aga gtc gcc gaa gcc atg agc caa gyc amc mat gcc aat atc atg cag aga ggc aat ttc ara ggc cma aag aga atc rtc aaa Segment 26
M M Q R G N F K G Q K R I I K C F N C G K E G H L A R N C R
              R P   V                                 I K
atg atg caa agg gga aac ttt arg gga cmg aaa agg att rtc aag tgc ttt aac tgt gga aag gaa ggc cat mtc gct arg aat tgc aga Segment 27
C F N C G K E G H L A R N C R A P R K K G C W K C G K E G H
                        I K                                R
tgt ttc aat tgc ggc aaa gag gga cac mtt gcc ara aac tgt agg gcc cct aga aag aaa ggc tgt tgg aaa tgc gga aag gaa ggc cat Segment 28
A P R K K G C W K C G K E G H Q M K D C T E R Q A N F L G K
                          R
gct ccc agg aaa aag gga tgt tgg aag tgc gga ara gag gga cac cag atg aag gat tgc aca gag aga cag gct aac ttt ctg gga aag Segment 29
Q M K D C T E R Q A N F L G K I W P S N K G R P G N F P Q S
                                                        H   L
                                                        S
caa atg aaa gac tgt acc gaa agg caa gcc aat ttc ctc ggc aaa atc tgg ccc tcc mrc aaa ggc aga ccc gga aac ttt cyc caa agc
```

FIGURE 12 (Cont)

```
I  W  P  S  N  K  G  R  P  G  N  F  P  Q  S  K  P  E  P  T  A  P  P  A  E  N  F  G  F  G      Segment 30
            H                          L                                      S              R
            S
att tgg cct agc mrc aag gga agg cct ggc aat ttc cyg cag tcc arg cct gag cct acc gct ccc gcc gaa atc ttt rga ttc ggc K  P  E  P  T  A  P  P  A  E  N  F  G  F  G  E  E  T  T  P  S  P  K  Q  E  Q  K  D  K  E      Segment 31
R                             S              R                          Q              P
ara ccc gaa ccc aca gcc cct ccc gct gag art ttc rgg ttc gga gag gaa acc aca ccc tcc cma aag caa gag cma aag gat aag gag E  E  T  T  P  S  P  K  Q  E  Q  K  D  K  E  H  Y  P  P  S  A  S  L  K  S  L  F  G  N  D      Segment 32
                        Q              P      L              L
gaa gag aca acc cct agc cmg aaa cag gaa cmg aaa gac aaa gac cwc tac ccc cct tya gcc agc ctc aag tcc ctg ttt ggc aat gac Ⓗ  Y  P  P  S  A  S  L  K  S  L  F  G  N  D  P  L  S  Q                                        Segment 33
L                 L                                      S
cwc tat cct ccc tya gct tcc ctg aaa agc ctc ttc gga aac gat ccc tya tcc caa
```

FIGURE 12 (Cont)

POL OVERLAPPING SEGMENTS

```
F F R E N L A F Q Q G K A R E F S S E Q T G A N S S A S R K          Segment 1
        T                 P           P             R     P T
ttc ttt agg gaa amc ctg gct ttc cmg caa ggc raa gcc aga gag ttt ycc agc gaa cag aca rga gcc aat agc ycc rcc tcc agg aaa F S S E Q T G A N S S A S R K L G D G G G A E R Q G T S S S          Segment 2
  P                 P T                     D
ttc yct tcc gag caa aca rgg gct aac tcc yct rca agc aga aag ctg gga gac gga gcc gas aga cag gcc gga aca agc tcc agc L G D G G G A E R Q G T S S S F P Q I T L W Q R P L V T              Segment 3
                  D                         L N
ctc ggc gat ggc gga ggc gct gaw agg cac ggc acc tcc agc tcc ytc arc ttt

```
                                                                                            Segment 7
K  P  K  M  I  G  G  I  G  G  F  I  K  V  R  Q  Y  D  Q  I  L  I  E  I  C  G  K  K  A  I
                                                                                  H
aaa ccc aaa atg gga ggc att gga ggc ttt atc aaa gtc agg cag tat gac caa atc mtt atc gaa atc tgt gga mas aag gct atc Segment 8
Q  Y  D  Q  I  L  I  E  I  C  G  K  K  A  I  G  T  V  L  V  G  P  T  P  V  N  I  I  G  R
         H                         (H)
caa tac gat cag att mtt att gag att tgc ggc mas aaa gcc att ggc aca gtg ctc gtg gga cct acc cct gtg aat atc att ggc aga Segment 9
G  T  V  L  V  G  P  T  P  V  N  I  I  G  R  N  M  L  T  Q  I  G  C  T  L  N  F  P  I  S
                                             L                  R
gga acc gtc ctg gtc ggc ccc aca ccc gtc aac att atc gga agg aac atg ctg aca cag mtt ggc ygc acc ctc aac ttt ccc att agc Segment 10
N  M  L  T  Q  I  G  C  T  L  N  F  P  I  S  P  I  D  T  V  P  V  K  L  K  P  G  M  D  G
   L                  R                                E
aat mtg ctc acc caa mtc gga ygc aca ctg aat ttc cct atc tcc cct atc gas aca gtg cct gtg aaa ctg aaa ccc gga atg gat ggc Segment 11
P  I  D  T  V  P  V  K  L  K  P  G  M  D  G  P  K  V  K  Q  W  P  L  T  E  E  K  I  K  A
      E
cct atc gaw acc gtc ccc gtc aag ctc aag cct ggc atg gac ggc ccc aaa gtg aaa cag tgg ccc ctc acc gaa gag aaa atc aaa gcc Segment 12
P  K  V  K  Q  W  P  L  T  E  E  K  I  K  A  L  T  E  I  C  K  E  M  E  E  E  G  K  I  S
                                       A  T              K                             Q
cct aag gtc aag caa tgg cct ctg aca gag aag att aag gct ctg aca gmg att tgc ama gag atg gag vaa gag gga aag att agc
```

Segment 13

```
L  T  E  I  C  K  E  M  E  E  E  G  K  I  S  K  I  G  P  E  N  P  Y  N  T  P  V  F  A  I
      A        T                       R                                            I
               Q
ctc acc gmg atc tgt ama gaa atg gaa gaa gaa vaa gaa atc tcc arg att ggc aaa atc tcc arg att ggc cct gag aat cca ccc tat aac aca ccc rtc ttt gcc att
```

Segment 14

```
K  I  G  P  E  N  P  Y  N  T  P  V  F  A  I  K  K  K  D  S  T  K  W  R  R  K  L  V  D  F  R
R                                      I
arg atc gga ccc gaa aac cct tac aat acc cct gct atc aag aaa aag gac tcc acc aaa tgg aga aag ctc gtg gat ttc aga
```

Segment 15

```
K  K  K  D  S  T  K  W  R  R  K  L  V  D  F  R  E  L  N  K  R  T  Q  D  F  W  E  V  Q  L  G
aaa aag gat agc aca aag tgg agg aaa ctg gtc gac ttt agg gag ctc aac aaa agg aca cag gat ttc tgg gag gtc cag ctc ggc
```

Segment 16

```
E  L  N  K  R  T  Q  D  F  W  E  V  Q  L  G  I  P  H  P  A  G  L  K  K  K  S  V  T  V
gaa ctg aat aag aga acc caa gac ttt tgg gaa gtc caa ctg gga atc cct cac cct gct gga ctg aaa aag aag tcc gtg aca gtg
```

Segment 17

```
I  P  H  P  A  G  L  K  K  K  S  V  T  V  L  D  V  G  D  A  Y  F  S  V  P  L  D  E  S
                                                                                    K  D
                                                                                       G
att ccc cat ccc gcc ggc ctc aag aaa aag agc gtc acc gtc ctg gat gtg gga gac gct tac ttt agc gtc ccc ctc gac raa rrc
```

```
L D V G D A Y F S V P L D E S F R K Y T A F T I P S I N N E        Segment 18
                                K D                   T
                                G
ctc gac gtc ggc gat gcc tat ttc tcc gtg cct ctg gat raa rrc ttc aga aag tat acc gct ttc aca atc cct agc aya aac aat gag F R K Y T A F T I P S I N N E T P G I R Y Q Y N V L P Q G W        Segment 19
                    T
ttt agg aaa tac aca gcc ttc acc att ccc tcc ayc aat aac gaa acc cct ggc att agg tat cag tat aac gtc ctg cct cag gga tgg T P G I R Y Q Y N V L P Q G W K G S P A I F Q S S M T K I L        Segment 20
                                                   P Q
aca ccc gga atc aga tac caa tac aat gtg ctc ccc caa ggc tgg aag gga tcc cca att ttc caa agc tcc atg acc maa atc ctc K G S P A I F Q S S M T K I L E P F R I K N P E M V I Y Q Y        Segment 21
         P                         K Q             D
aaa ggc agc cct atc ttt cag tcc agc atg mca mag att ctg gag cct ttt agg awa maa acc cct gas atg gtc atc tat cag tat E P F R I K N P E M V I Y Q Y M D D L Y V G S D L E I G Q H        Segment 22
         K Q             D
gaa ccc ttc aga awa mag aat ccc gaw atg gtg att tac caa tac atg gac gat ctg tat gtg gga agc gat ctg gaa atc gga cag cat
```

FIGURE 12 (Cont)

```
                                                                                        Segment 23
M  D  D  L  Y  V  G  S  D  L  E  I  G  Q  H  R  T  K  I  E  E  L  R  A  H  L  L  R  W  G
                                                       A                    E
                                                                            Q
atg gat gac ctc tac gtc ggc tcc gac ctc gag att ggc caa cac agr aaa atc gaa gag ctc ctg ara tgg gga Segment 24
R  T  K  I  E  E  L  R  A  H  L  L  R  W  G  F  T  T  P  D  K  K  H  Q  K  E  P  P  F  L
     A                    E
                          Q
aga rca aag att gag gaa ctg aga smg cat ctg ctc ara tgg ttc aca acc cct gac aaa aag cat cag aaa gag cct ccc ttt ctg Segment 25
F  T  T  P  D  K  K  H  Q  K  E  P  P  F  L  W  M  G  Y  E  L  H  P  D  R  W  T  V  Q  P
ttt acc aca ccc gat aag aaa cac caa aag gaa ccc cct ttc ctc tggr atg gga tac gaa ctg cat ccc gat agg tgg acc gtc cag cct Segment 26
W  M  G  Y  E  L  H  P  D  R  W  T  V  Q  P  I  E  L  P  E  K  D  S  W  T  V  N  D  I  Q
                                           V                E
                                           Q
tgg atg ggc tat gag ctc cac cct gac aga tgg aca gtg caa ccc atc swg ctc ccc gaa aag gas tcc tgg aca gtg aat gac att cag Segment 27
I  E  L  P  E  K  D  S  W  T  V  N  D  I  Q  K  L  V  G  K  L  N  W  A  S  Q  I  Y  A  G
V                E                                                                       P
Q
att swg ctg cct gag aaa gaw agc tgg acc gtc aac gat atc caa aac ctc gtg gga aag ctc aac tgg gcc tcc cag att tac scc gga
```

FIGURE 12 (Cont)

```
K L V G K L N W A S Q I Y A G I K V K Q L C K L L R G T K A                                    Segment 28
                                          R                              A
aaa ctg gtc ggc aaa ctg aat tgg gct agc caa atc tat gct ggc atc aaa gtg caa arg ctg tgt aag ctc ctg aga ggc rcc aaa gcc I K V K Q L C K L L R G T K A L T D I V P L T E E A E L E L              Segment 29
      R                        A                  E T
att aag gtc ara cag ctg tgc aaa ctc ctg agg gga rca aag gct ctc aca gas att gtg mca ctg aca gag gaa gcc gaa ctg gaa ctg L T D I V P L T E E A E L E L E E N R E I L R E P V H G V Y              Segment 30
        E                      A                              K
ctc acc gaw atc gtc mca ctc acc gaa gag gct gag ctc gag gaa aac aga gag att ctg arg gaa ccc gtc cac gga gtg tat E E N R E I L R E P V H G V Y Y D P S K D L V A E V Q K Q G              Segment 31
A                                                         I
gmg gag aat agg gaa atc ctc ara gag cct gtg cat ggc gtc tac tac gat ccc tcc aag gat ctg rtc gct gaa rtc caa aag caa ggc Y D P S K D L V A E V Q K Q G Q D Q W T Y Q I Y Q E P F K N              Segment 32
                  H I                   G                 F
tat gac cct agc aaa gac ctc rtt gcc gag rtt cag aaa cag gga grt cag tgg aca twt cag att twc caa gag cct ttc aaa aac Q D Q W T Y Q I Y Q E P F K N L K T G K Y S R K R S A H T N              Segment 33
G                         F                         A    M   G
caa grc caa tgg acc twc caa atc twt cag gaa ccc ttt aag aat ctg aaa acc gga aag tat kcc aga awg aga rgc gct cac aca aac
```

FIGURE 12 (Cont)

```
L  K  T  G  K  Y  S  R  K  R  S  A  H  T  N  D  V  R  Q  L  T  E  V  V  Q  K  I  A  T  E                    Segment 34
               A  M           G                                            A  A          V
ctc aag acc ggc aaa tac kct agg rgt gcc cat acc aat gac ctc arg caa ctg aca gmg gyt gtg caa aag rtt gcc aca gag D  V  R  Q  L  T  E  V  V  Q  K  I  A  T  E  S  I  V  I  W  G  K  T  P  K  F  R  L  P  I                    Segment 35
   K              A  A          V                                                      K
gat ctg ara cag ctc acc gma gyc gtc cag aaa rtc gct acc gaa agc att gtg att tgg gga aag aca ccc aaa ttc ara ctg cct atc S  I  V  I  W  G  K  T  P  K  F  R  L  P  I  Q  R  E  T  W  E  T  W  M  M  E  Y  W  Q  A                    Segment 36
                                          K                       A     T  D
tcc atc gtc atc tgg ggc aaa acc cct aag ttt arg ctc ccc att cag gag gaa rcc tgg gaa tat tgg caa gcc Q  R  E  T  W  E  T  W  M  M  E  Y  W  Q  A  T  W  I  P  E  W  E  F  V  N  T  P  P  L  V                    Segment 37
            K                 A  T  D
caa arg gaa acc tgg gag rct tgg ayg gam tac tgg cag gct acc tgg atc cct gag tgg gag ttt gtg aat acc cct ctc gtg T  W  I  P  E  W  E  F  V  N  T  P  P  L  V  K  L  W  Y  Q  L  E  K  D  P  I  V  G  A  E                    Segment 38
                                                                              E  A     V
aca tgg att ccc gaa tgg gaa ttc gtc aac aca ccc cct ctg aag ctc tgg tat cag ctc gag aaa gas cct atc gyt ggc gyt gag K  L  W  Y  Q  L  E  K  D  P  I  V  G  A  E  T  F  Y  V  D  G  A  A  S  R  E  T  K  L  G                    Segment 39
                        E              A     V                       N
aaa ctg tgg tac caa ctg gaa aag gam ccc att gyc gga gyc gaa acc ttt tac gtc gac gga gcc gct arc aga gag aca aag ctc ggc
```

FIGURE 12 (Cont)

```
T F Y V D G A A S R E T K L G K A G Y V T D R G R Q K V I S                          Segment 40
                N
aca ttc tat gtg gat ggc gct gcc art agg gaa acc aaa ctg gga aag gct ggc tat gtg aca gac aga ggc aga cag aaa rtc rtt agc K A G Y V T D R G R Q K V I S L T E T T N Q K T E L H A I H                          Segment 41
                        I V                                Q   Q
aaa gcc gga tac gtc acc gat agg gga agg caa aag rtt rtc ctg aca gas aca acc aat cag aaa acc gaa ctg caw gcc att cam L T E T T N Q K T E L H A I H H A L Q D S G S E V N I V T D                          Segment 42
      D                   Q Q                 L
ctc acc gam acc aca aag gag ctc cam gct atc caw ctg caa gac tcc ggc ctg caa gac att gtg aca gac L A L Q D S G S E V N I V T D S Q Y A L G I I Q A Q P D R S                          Segment 43
            L                                   L
ctc gcc ctc cag gat agc gga tyg gaa tac gct ctg gga atc att cwg gct cag cct gac ara agc S Q Y A L G I I Q A Q P D R S E S E V V S Q I I E E L I K K                          Segment 44
                L                               K           K
                                                Q
tcc cag tat gcc ctc ggc att atc cwa gcc caa ccc gat arg tcc gag tcc gag att atc gaa vag ctc atc aaa aag E S E V V S Q I I E E L I K K E K V Y L S W V P A H K G I G                          Segment 45
            L N                     K S     R     A
                                    Q
gag tcc gag atc gtg art cag att atc gaa vag ctc atc aaa aag gaa arg gtc tac ctc kcc tgg gtg cct gcc cac aag gga atc gga
```

Segment 46
```
E K V Y L S W V P A H K G I G G N E Q V D K L V I S G I R K
R A                                       S A
gag ara gtg tat ctg kct tgg gtc ccc gct cat aaa ggc att ggc gga aac gaa cag gtc gac aaa ctg gtc akc kct ggc att agg aaa
```

Segment 47
```
G N E Q V D K L V I S G I R K V L F L D G I N K A Q E E H E
                    S A                               D
ggc aat gag caa gtg gat aag ctc gtg akt kcc gga atc aga aag gtg ctc ttc ctc gac gga atc rat aag gct cag gaa gag cac gaa
```

Segment 48
```
V L F L D G I N K A Q E E H E R Y H S N W R T M A S D F N L
          D                                           N E
gtc ctg ttt ctg gat ggc att caa gcc aaa gcc caa gag gaa cat gag arg tat cac tcc aac tgg agg aca atg gct arc gam ttc aat ctg
```

Segment 49
```
Ⓡ Y H S N W R T M A S D F N L P P I V A K E I V A N C D K C
K                         N E                         S
                                                      C
ara tac cat agc aat tgg aga acc atg gcc art gas ttt aac ctc ccc cct atc gtc sct aag gaa atc gtc gcc wrt tgc gat aag tgt
```

Segment 50
```
P P I V A K E I V A N C D K C Q L K G E A M H G Q V D C S P
P                 S                           I         N
                  C
cct ccc att gtg acc aaa gag att gtg gct wrc tgt gac aaa tgc cag ctc aag gga gag gct atk cac gga cag gtc rac tgt agc cct
```

```
Q  L  K  G  E  A  M  H  G  Q  V  D  C  S  P  G  I  W  Q  L  D  C  T  H  L  E  G  K  V  I                    Segment 51
            I                       N                                                       I
caa ctg aaa ggc gaa gcc ats cat ggc caa gtg rat tgc tcc ccc ggc att tgg caa ctg gat tgc aca cac ctc gag gga aag rtt atc G  I  W  Q  L  D  C  T  H  L  E  G  K  V  I  L  V  A  V  H  V  A  S  G  Y  I  E  A  E  V                    Segment 52
                                           I
gga atc tgg cag ctc gac tgt acc cat ctg gaa ggc aaa rtc att ctg gtc gcc gtc cac gtc gcc tcc ggc tac att gag gct gag gtc L  V  A  V  H  V  A  S  G  Y  I  E  A  E  V  I  P  A  E  T  G  Q  E  T  A  Y  F  L  L  K                    Segment 53
                                                                                        I
ctc gtg gct gtg cat gtg gct agc gga tat atc gaa gag aca ggc caa gag acc gct tac ttt mtc ctc aag I  P  A  E  T  G  Q  E  T  A  Y  F  L  L  K  L  A  G  R  W  P  V  K  V  I  H  T  D  N  G                    Segment 54
                                                                            R  T
att ccc gct gag aca ggc caa gag acc gct tac ttc mtt ctg aaa ctg gct ggc aga tgg cct gtg ara ryc att cac aca gac aat ggc L  A  G  R  W  P  V  K  V  I  H  T  D  N  G  S  N  F  T  S  A  A  V  K  A  A  C  W  W  A                    Segment 55
               R  T                                                         T  T
ctc gcc gga agg tgg ccc gtc arg rya atc cat acc gat aac gga agc aat ttc aca agc rct rcc gtc aag gct gcc.tgc tgg tgg gct S  N  F  T  S  A  A  V  K  A  A  C  W  W  A  N  I  K  Q  E  F  G  I  P  Y  N  P  Q  S  Q                    Segment 56
      T  T                                            G  Q
tcc aac ttt acc tcc rcc rct gtg aaa gcc gct tgt tgg gcc rrt atc maa cag gaa ttc gga atc cct tac aat ccc caa agc caa
```

FIGURE 12 (Cont)

```
N I K Q E F G I P Y N P Q S Q G V V E S M N K E L K K I I G      Segment 57
G   Q
rrc att mag caa gag ttt ggc att ccc tat aac cct cag tcc cag ggc gtc gtg gaa agc atg aac aaa gag ctc aag aaa atc att ggc G V V E S M N K E L K K I I G Q V R E Q A E H L K T A V Q M      Segment 58
                                                        D
gga gtg gtc gag tcc atg aat aag gaa ctg aaa aag att atc gga cag gtc agg gam cag gct gag cat ctg aaa acc gct gtg caa atg Q V R E Q A E H L K T A V Q M A V F I H N F K R K G G I G G      Segment 59
D                                                       R
caa gtg aga gas caa gcc gaa cac ctc aag aca gcc gtc cag atg gcc ttc att cac aat ttc aaa agg ara ggc gga atc gga ggc A V F I H N F K R K̂ Ⓡ G G I G G Y S A G E R I I D I I A T D I    Segment 60
                                                    V    S
gct gtg ttt atc cat aac ttt aag aga arg gga att ggc gga tac tcc gcc gga gag aga atc att atc gct asc gat atc Y S A G E R I I D I I A T D I Q T K E L Q K Q I T K I Q N F      Segment 61
                    V        S                                N  L
tat agc gct ggc gaa agg att rtc gat atc att gcc wcc gac att cag tat aag gaa ctg caa aas caa atc mya aag att cag aat ttc Q T K E L Q K Q I T K I Q N F R V Y Y R D S R D P I W K G P      Segment 62
            N   L                                              L
caa tac aaa gag ctc cag aam cag att myc aaa atc caa aac ttt agc gtc tac tat agg gat agc aga gac cct mtc tgg aag gga ccc
```

FIGURE 12 (Cont)

```
Segment 63
R V Y Y R D S R D P I W K G P A K L L W K G E G A V V I Q D
aga gtg tat tac aga gac tcc agg gat ccc mtt tgg aaa ggc cct gcc aaa ctg ctc tgg aaa ggc gaa ggc gct gtg gtc atc caa gac
                                                    L Segment 64
A K L L W K G E G A V V I Q D N S D I K V V P R R K A K I I
gct aag ctc ctg tgg aag gga gag ggc gct gtg gtc atc cag gat aac tcc gac att aag gtc gtg cct agg aga aag gct aag att atc Segment 65
N S D I K V V P R R K A K I I R D Y G K Q M A G D D C V A G
aat agc gat atc aaa gtg gtc ccc aga agg aaa gcc aaa atc att agg gat tac gga aag caa atg gct ggc gmt gac tgt gtg gct rgc
                                                                                                  A              S Segment 66
R D Y G K Q M A G D D C V A G R Q D E D
agg gat tac gga aag caa atg gct ggc gmt gac tgt gtg gct agg cag gac gaa gac
                        A                                  S
```

FIGURE 12 (Cont)

VIF OVERLAPPING SEGMENTS

```
                                                                                                L
M  E  N  R  W  Q  V  M  I  V  W  Q  V  D  R  M  R  I  R  T  W  N  S  L  V  K  H  H  M  Y
atg gaa aac aga tgg caa gtg mtg atc gtc tgg caa gtg gat agg atg arg att agg aca tgg aaw

```
E K D W Q L G H G V S I E W R Q K R Y S T Q V D P P D L A D Q      Segment 6
    R   H   Q                   L S                         Ⓗ
                                K                           G gaa arg gat tgg caw ctg gga cas gga gtg tcc atc gaa tgg aga mwg aaa ags tat agc aca cag gtc gac cct gtc ctc gcc gat cas Q K R Y S T Q V D P P D L A D Q L I H L Ⓠ Y F D C F S D S T I      Segment 7
  L S                   G       H    Ⓗ                   A
  K                                  Ⓨ                   A mwg aag agm tac tcc acc caa gtg gat ccc grt ctg gct gac caw ctg att cac ctc yas tat ttc gat tgc ttt kcc gat agc rca atc L I H L Q Y F D C F S D S T I R R A I L G Q I V R R R C E Y        Segment 8
      H

Segment 11

```
K A L I T P K K I R P P L P S V K K L T E D R W N K P Q K I
  T         K                         K       E         T
ama gcc ctc atc ama ccc aaa aag att arg cct ccc ctc ccc tcc gtg aaa aag ctc acc gaa gac ara tgg aat rag cct caa aag aya
```

Segment 12

```
V K K L T E D R W N K P Q K I K G H R E N H T M N G H
        K       E         T     R       G
gtc aag aaa ctg aca gag gat arg tgg aac raa ccc cag aaa ayc aag gga crc aga gra aat cac aca atg aat ggc cat
```

FIGURE 12 (Cont)

VPR OVERLAPPING SEGMENTS

```
M E Q A P E D Q G P Q R E P Y N E W A L E L L E E L K Q E A   Segment 1
                S S                 T                 H
                                                      N
atg gaa cag gct ccc gaa gac caa rgc yct cag aga gag cct tac aat gag tgg rcc ctc gag ctc ctg gaa gag ctc aag mam gag gct N E W A L E L L E E L K Q E A V R H F P R P W L H (N) L G Q (Y)   Segment 2
      T                 H                           G         H
                        N                          (S)
aac gaa tgg rca ctg gaa ctg ctc gag gaa ctg aaa maw gaa gcc gtg aga cac ttt ccc aga ccc tgg ctg cat rrc ctc ggc caa yac V R H F P R P W L H N L G Q Y I Y E T Y G D T W S G V E A L   Segment 3
                    G       H                   E
                    S
gtc agg cat ttc cct agg cct tgg ctc cac rrc ctg gga cag yac atc tat gag aca tac gga gac aca tgg kmg gga gtg gaa gcc ctc I Y E T Y G D T W (S) G V E A L I R T L Q Q L M F I H F R I G   Segment 4
                   E                 I           L   V
att tac gaa acc tat ggc gat acc tgg kma ggc gtc gag gct ctg atc aga ayc ctc cag caa ctg mtg ttt rtc cat ttc aga atc gga
```

FIGURE 12 (Cont)

```
I   R   T   L   Q   Q   L   M   F   I   H   F   R   I   G   C   Q   H   S   R   I   G   I   L   R   Q   R   R   A   R      Segment 5
        I                   L       V                           R                               I                   G
                                                                                                T
att agg ayc ctg caa cag ctc mtg ttc rtt cac ttt agg att ggc tgc crg cac tcc agg att ggc att myc aga cag aga agg gsc aga C   Q   H   S   R   I   G   I   L   R   Q   R   R   A   R   N   G   A   S   R   S                                          Segment 6
    R                               I                   G               S
                                    T
tgt cra cat agc aga atc gga atc myc agg caa agg aga gst agg aac gga kcc tcc agg tcc
```

(In Segment 6, the L and I at position 9 are circled.)

FIGURE 12 (Cont)

TAT OVERLAPPING SEGMENTS

Segment 1
```
M E L V D P N L E P W N H P G S Q P T T A C S K C Y C K K C
  D P         K                 K         T       N
atg gaw cyc gtc gac cct aas ctc gag cct tgg aaw cac cct ggc tcc cag cct amg aca gcc tgt wmc aaa tgc tat tgc aaa aag tgc
```

Segment 2
```
S Q P T T A C S K C Y C K K C C F H C Q L C F L K K G L G I
      K               T             Y       V         T
agc caa ccc ama acc gct tgc wmc aag tgt tac tgt tgc ttc cac tgt tgc aag aaa tgt tac tgt cag ctc ctg ama aag gga ctg gga atc
```

Segment 3
```
C F H C Q L C F L K K G L G I S H G R K K K R K Q R R R G A P Q
        Y       V         T               Y           R     R
tgt ttc cat tgc caa stg tgt ttt ctc amg aaa ggc ctc ggc att agc cac gga agg aaa aag aga ara cag aga agg sga gct ccc caa
```

Segment 4
```
S H G R K K R K Q R R R G A P Q S R K D H Q Y P I P E Q P L P
          Y         R       R           S E                   S
tcc yat ggc aga aag aag agg caa agg agc gcc cct cag agc agm rag gat cac caa tac cct atc yct gag caa ccc ctc ycc
```

Segment 5
```
S R Q D H Q Y P I P E Q P L P Q T R G G N P T D D P K E S K K
  S                         S P         D       G E
tcc aga cag gac cat cag tat ccc att ycc gaa cag cct ctg yct caq mca agg gga grc aat ccc aca grc cct rag gaa agc aaa aag
```

FIGURE 12 (Cont)

Segment 6

```
Q T R G (G) N P T D P K E S K K E V A S K T E T D P C D
    P    D       G   E           K    E    A            F
caa mcc aga ggc grt aac cct acc grt ccc raa gag tcc aag aaa rag gtc gmg tcc aag rca gag aca gac cct tkt gac
```

\* different

FIGURE 12 (Cont)

REV OVERLAPPING SEGMENTS

Segment 1

```
M   A   G   R   S   G   S   T   D   E   E   L   L   R   A   V   R   I   I   N   I   L   Y   Q   S   N   P   Y   P   S  [T]
                        D                                                       K                               K
                        N
atg gct ggc aga agc gga rrc aca gac gaa gag ctc ctg arg gct rtc aga atc att aas att ctg tat cag tcc aac cct tac cct wcc
```

Segment 2

```
V   R   I   I   N   I   L   Y   Q   S   N   P   Y   P   S  [T]  S   E   G   T   R   Q   T   R   K   N   R   R   R   R   W
        I                           K                                                   S       A               R
rtt agg att atc aaw atc ctc tac caa agc aat ccc tat ccc wca agc gaa ggc caa rcc aga arg aat agg aga agg aga tgg
```

Segment 3

```
S   E   G   T   R   Q   T   R   K   N   R   R   R   R   W   R   A   R   Q   R   Q   I   R   A   I   S   E   R   I   L
                S       A               R                                       E               H   S
                                                                                                W
tcc gag gga wca aga cag rct agg ara aac aga agg tgg agg gmg agg caa agg caa atc crc kcc atc tcc gag wgg att ctg
```

Segment 4

```
R   A   R   Q   R   Q   I   R   A   I   S   E   R   I   L   S   T   C   L   G   R   S   A   E   P   V   P   L   Q   L
                E               H   S                                                   P
                                W
aga gma aga cag aga cag att crt kct att agc gaa wgg atc ctc ggc aga amc tkc ctc agc aga yct gct gag cct gtg cct ctg caa ctg
```

Segment 5

```
S   T   C   L   G   R   S   A   E   P   V   P   L   Q   L   P   P   L   E   R   L   H   L   D   C   S   E   D   C   G
            N   F                       P                                                       N                       S   D
tcc amc tkt ctg gga agg yct gcc gaa ccc gtc ccc cct cag ctc ccc cct ctg gaa agg ctc mac ctc gac tgt agc gaa gac wgt grc
```

FIGURE 12 (Cont)

```
P P L E R L H L D C S E D C G T S G T Q Q S Q G T E T G V G      Segment 6
        N                 S D
cct ccc ctc gag aga ctg mac ctg gat tgc tcc gag gat wgc grt acc tcc ggc aca cag caa ggc aca gag aca gga gtg gga T S G T Q Q S Q G T E T G V G R P Q I S G E S S V I L G P G      Segment 7
                                          L              A V
aca agc gga acc caa cag tcc cag gga acc gaa acc ggc gtc ggc mrc cct cag att tyg gga gag tcc agc gyt rtc ctc ggc ycc gga Ⓡ Ⓝ P Q I S G E Ⓛ S V I L G P G T K N                           Segment 8
 S                                       S
mrc ccc caa atc tya ggc gaa agc tcc gyc rtt ctg gga yct ggc acc aaa aac
```

FIGURE 12 (Cont)

VPU OVERLAPPING SEGMENTS

Segment 1

```
M  T  P  L  E  I  I  A  I  V  A  F  I  V  A  L  I  I  A  I  V  V  W  T  I  A  Y  I  E  Y
   S  Q  R                                         L
atg aca ycc ctc sag ara atc gct atc gtc gcc ctc mta gcc att gtg gtc tgg aca atc gyc twc att gag tat
```

Segment 2

```
L  I  I  A  I  V  V  W  T  I  A  Y  I  E  Y  R  K  L  L  R  Q  R  R  I  D  R  L  I  K  R
                        V  F                  K        K              K                 E
ctg att mtc gct atc gtc gtg tgg acc att gyg twt atc gaa tac arg aaa ctg ctc arg caa agg ara atc gat agg ctc atc raa agg
```

Segment 3

```
R  K  L  L  R  Q  R  R  I  D  R  L  I  K  R  T  R  E  R  A  E  D  S  G  N  E  S  E  G  D
   K                                    K                 E  I
ara aag ctc ctg ara cag aga agg att gac aga ayc aga gag gcc gaa gac tcc gag gga g

ENV OVERLAPPING SEGMENTS

Segment 1

```
M   R   V   K   E   T   Q   M   N   W   P   N   L   W   K   W   G   T   L   I   L   G   L   V   I   I   C   S   A   S
                                            R                       M           M
atg aga gtg aaa gag aca cag atg aac tgg ccc aat ctg tgg arg tgg ggc aca mtg gtc ats att tgc tcc gcc tcc
```

Segment 2

```
W   G   T   L   I   L   G   L   V   I   I   C   S   A   S   D   N   L   W   V   T   V   Y   Y   G   V   P   V   W   R
        M               M                               E
tgg gga acc wtg atc ctc ggc wtg gtg atk atc tgt agc gct gas aat ctg t

```
N   F   N   M   W   K   N   N   M   V   E   Q   M   Q   E   D   V   I   S   L   W   D   Q   S   L   K   P   C   V   K      Segment 7
                            D       D           H       I
aat ttc aat atg tgg aag aat rac atg gtg gam cag atg cam gaa gac rtt atc tcc ctg tgg gac caa agc ctc aag cct tgc gtc aag D   V   I   S   L   W   D   Q   S   L   K   P   C   V   K   L   T   P   L   C   V   T   L   N   C   T   N   A   N   L      Segment 8
    I
gat rtc att agc ctc tgg gat cag tcc ctg aaa ccc tgt gtg aaa ctg aca ccc ctc tgc gtc acc ctc aac tgt acc aat gcc aat ctg L   T   P   L   C   V   T   L   N   C   T   N   A   N   L   I   N   V   N                                                  Segment 9
ctc acc cct ctg tgt gtg aca ctg aat tgc aca aac gct aac ctc atc aat gtg aat
```

FIGURE 12 (Cont)

GAP IN SEGMENTS DUE TO HYPERVARIABLE REGIONS 1 AND 2

Segment 1

```
Y   R   L   I   N   C   N   T   S   V   I   K   Q   A   C   P   K   V   S   F   D   P   I   P   I   H   Y   C  [T]  P
                S                   A       T                       I   T       E                               A
tac aga ctg att arc tgt aac aca agc gyt atc ama cag gct tgc cct aag rtt asc ttt gas cct atc cct atc cat tac tgt rcc cct
```

Segment 2

```
P   K   V   S   F   D   P   I   P   I   H   Y   C  [T]  P   A   G   Y   A   I   L   K   C   N   D   K   N   F   N   G
        I   T       E                               A               F                           N       K
                                                                                                        T
ccc aaa rtc wcc ttc gam ccc att ccc att cac tat tgc rct ccc gcc gga twc gct atc ctc aag tgt aac rat aag amm ttc aat ggc
```

Segment 3

```
A   G   Y   A   I   L   K   C   N   D   K   N   F   N   G   T   G   P   C   K   N   V   S   S   V   Q   C   T   H   G
        F                           N       K                               T               T
                                            T
gct ggc twt gcc att ctg aaa tgc aat rac aaa ams ttt aac gga acc gga ccc tgt amg aat gtg tcc asc gtc cag tgt acc cat ggc
```

Segment 4

```
T   G   P   C   K   N   V   S   S   V   Q   C   T   H   G   I   K   P   V   V   S   T   Q   L   L   L   N   G   S   L
                T               T                               R
aca ggc cct tgc ama aac gtc agc wcc gtg caa tgc aca cac gga atc ara ccc gtc gtg tcc acc caa ctg ctc ctg aat ggc tcc ctg
```

Segment 5

```
I   K   P   V   V   S   T   Q   L   L   L   N   G   S   L   A   E   E   E   I   I   I   R   S   E   N   L   T   N   N
    R                                                                       V   V                       F       D
att arg cct gtg gtc agc aca cag ctc ctg ctc aac gga agc ctc gcc gaa gag gaa rtc rtt atc aga agc gaa aac ytt acc rat aac
```

FIGURE 12 (Cont)

```
A   E   E   E   I   I   I   R   S   E   N   L   T   N   N   A   K   T   I   I   V   H   L   N   E   S   V   E   I   N      Segment 6
                V   V                       F       D       V                       Q           K           V
gct gag gaa gat rtt rtc att agg tcc gag aat ytc aca rac aat gyc aaa acc att atc gtc cam ctc aac raa agc gtc gwg att aac A   K   T   I   I   V   H   L   N   E   S   V   E   I   N   C   T   R   P   N   N   N   T   R   K                      Segment 7
V                       Q           K           V                           S                   T
gyt aag aca atc att gtg caw ctg aat rag tcc gtg gwa atc aat tgc aca agg cct arc aat aac aca agg ama
```

FIGURE 12 (Cont)

GAP IN SEGMENTS DUE TO HYPERVARIABLE REGIONS 3, 4 AND 5

```
T  F  R  P  G  G  G  D  I  K  D  N  W  R  S  E  L  Y  K  Y  K  V  V  K  I  E  P  L  G  V          Segment 1
I                          N  M  R                                            E     K                    I
ayc ttt agg cct ggc gga ggc gat ats ara gac aat tgg aga agc gaa ctg tat aag gtc gtg rag att rag cct ctg gga rtc E  L  Y  K  V  V  K  I  E  P  L  G  V  A  P  T  R  A  K  R  R  V  V  E  R  E  K  R                    Segment 2
                                 E     K          raa        rtt Segment 7
```
R A I E A Q Q H L L Q L T V W G I K Q L Q A R V L A V E R Y
                M                                   I
aga gcc att gag gct cag caa cac wtg ctg caa ctg aca gtg tgg ggc att aag caa ctg caa gcc aga gtg ctc gcc rtt gag aga tac

```

Segment 8
```
G I K Q L Q A R V L A V E R Y L K D Q K F L G L W G C S G K
                      I               Q L     I
gga atc aaa cag ctc cag gct agg gtc ctg gct rtc gaa agg tat ctg aaa gac caa mag ytt ctg gga mtc tgg ggc tgt agc gga aag
```

Segment 9
```
L K D Q K F L G L W G C S G K I I C T T A V P W N S S W S N
        Q L     I             L         N           T
ctc aag gat cag maa ytc ctc ggc mtt tgg gga tgc tcc ggc aaa mtc att tgc aca acc rmt gtg cct tgg aac agc wcc tgg tcc aac
```

Segment 10
```
I I C T T A V P W N S S W S N K S L E E I W N N M T W M E W
L         N           T           F         D         I Q
mtt atc tgt acc aca rmc gtc ccc tgg aat tcc asc tgg agc aat aag tcc ytc gaa gag att tgg rat aac atg acc tgg ats saa tgg
```

Segment 11
```
K S L E E I W N N M T W M E W E R E I S N Y T N Q I Y E I L
    F         D         I Q                   S L     K
aaa agc ytt gag gaa atc tgg rac aat atg aca tgg atk sag tgg gag aga gag att agc aat tac aca arc cwa atc tat rag att ctg
```

Segment 12
```
E R E I S N Y T N Q I Y E I L T E S Q N Q Q D R N E Q E L L
                S L     K                           K D
gaa agg gaa atc tcc aac tat acc art cwg att tac raa atc ctc acc gaa agc caa aac caa cag gat agg aat gag maa gas ctc ctg
```

```
T  E  S  Q  N  Q  Q  D  R  N  E  Q  E  L  L  E  L  D  K  W  A  S  L  W  N  W  F  D  I  T          Segment 13
                                    K  D              A                             N  S
aca gag tcc cag aat cag caa gac aga aac gaa mag gam ctg ctc gmy ctc gac aaa tgg gct agc ctc tgg aat tgg ttt rac att asc E  L  D  K  W  A  S  L  W  N  W  F  D  I  T  N  W  L  W  Y  I  K  I  F  I  M  I  V  G  G          Segment 14
A                       N  S  K
gma ctg gat aag tgg gcc tcc ctg tgg aac tgg ttc rat atc wcc aam tgg ctg tgg tac att aag att atg att gtg gga ggc N  W  L  W  Y  I  K  I  F  I  M  I  V  G  G  L  I  G  L  R  I  V  F  A  V  L  S  I  V  N          Segment 15
K                                   V                              I
aam tgg ctc tgg tat atc aaa atc ttt atc atg atc gtc ggc gga ctg rtt ggc ctc agg att rtc ggc ctc tcc atc rtt aac L  I  G  L  R  I  V  F  A  V  L  S  I  V  N  R  V  R  Q  G  Y  S  P  L  S  F  Q  T  L  L          Segment 16
         V              I                  I                                                T
ctc rtc gga atc ctg aga atc ttc gct gtg ctc atc gtt aat aggr gtc agg caa ggc tat agc cct ctg tcc ttc caa acc ctc myc R  V  R  Q  G  Y  S  P  L  S  F  Q  T  L  L  P  A  P  R  G  P  D  R  P  E  G  I  E  E  E          Segment 17
                                          T                          L  G  R
aga gtg aga cag gga tac tcc ccc ctc agc ttt cag aca ctg myg ccc gct ccc aga ggc cct gac aga cyc gra agc att gag gaa gag P  A  P  R  G  P  D  R  P  E  G  I  E  E  E  G  G  E  Q  D  R  D  R  S  V  R  L  V  S  G          Segment 18
                        L  G  R                    R  G                             N
cct gcc cct agg gga ccc gat agg ccc gag ggc gga gag cra grc aga grc aga agc gtc agg ctc gtg art ggc
```

```
G G E Q D R D R S V R L V S G F L A L A W D D L R S L C L F      Segment 19
      R G                   N               S                N
gga ggc gaa crg grt agg tcc gtg aga ttc gcc gcc tgg gac gat ctg aga arc ctc tgc ctc ttc F L A L A W D D L R S L C L F S Y H R L R D L I L I A A R I     Segment 20
      S                 N                      F         V   T
ttt tyg gct ctg gct

```
I  A  V  A  E  G  T  D  R  V  I  E  V  A  Q  R  A  G  R  A  I  L  H  I  P  R  R  I  R  Q    Segment 25
                  G  W                 I        V                 W           N           T
att gcc gtc gcc gra kgg aca gac aga rtc att gag gtc gyc caa agg gct kgg aga gcc att ctg mat atc cct asa aga atc aga cag R  A  G  R  A  I  L  H  I  P  R  R  I  R  Q  G  L  E  R  A  L  L    Segment 26
         W           N           T        F
aga gcc kgg agg gct atc ctc mac att ccc asg agg att agg caa ggc ytt gag aga gcc ctc

NEF OVERLAPPING SEGMENTS

Segment 1

```
M   G   G   K   W   S   K   S   S   L   V   G   W   P   E   V   R   E   R   I   R   Q   T   P   P   A   A   A   E   G   V
                        C                                       A                       R   A   A
atg gga ggc aaa tgg tcc aag wgc tcc cyc gtc gga tgg ccc gma gtg aga gag atc aga cct gcc gct gag gga gtg
```

Segment 2

```
H P M S Q H G M E D E E R E V L I W K F D S R L A R R H I A     Segment 12
      I  C  L              D                     K            H  L     M
cat ccc ats rgc cwa cac gga atg gag g

The Genetic Code - First and Second Most Frequently Used Codons

| A<br>Ala | R<br>Arg | N<br>Asn | D<br>Asp | C<br>Cys | Q<br>Gln | E<br>Glu | G<br>Gly | H<br>His | I<br>Ile |
|---|---|---|---|---|---|---|---|---|---|
| GGC/GCT | AGG/AGA | AAC/AAT | GAC/GAT | TGC/TGT | CAG/CAA | GAA/GAG | GGC/GGA | CAC/CAT | ATC/ATT |

The Genetic Code - First and Second Most Frequently Used Degenerate Codons For TWO or More Amino Acids

TWO BASES AT A SINGLE POSITION

| | | | | | | | | | |
|---|---|---|---|---|---|---|---|---|---|
| AD GMC/GWT | RM AKT/ | ND RAC/RAT | DN RAC/RAT | CW TGS/TGK | QR CRG/CRA | ED GAS/GAM | GW KGG/ | HN MAC/MAT | IM ATS/ATK |
| AE GMG/GWA | RW WGG/YGG | NH NH | DA GMC/GMT | CR YGC/YGT | QE SAG/SAA | EQ SAG/SAA | GD GRC/GRT | HD SAC/SAT | IN AWC/AWT |
| AG GSC/GST | RC YGC/YGT | NI AWC/AWT | DE GAS/GAM | CG KGC/KGT | QH CAM/CAW | EA GMG/GMA | GC KGC/KGT | HQ CAM/CAW | IF WTC/WTT |
| AP SCC/SCT | RQ CRG/CRA | NK AAS/AAM | DG GRC/GRT | CF TKC/TKT | QL CWG/CWA | EG GRG/GRA | GE GRG/GRA | HR CRC/CRT | IR AKA/ |
| AS KCC/KCT | RH CRC/CRT | NS ARC/ART | DH SAC/SAT | CS WGC/WST | QK MAG/MAA | EK RAG/RAA | GA GSC/GST | HL CWC/CWT | IL MTC/MTT |
| AT RCC/RCT | RK ARG/ARA | NT AMC/AMT | DY KAC/KAT | CY TRC/TRT | QP CMG/CMA | EV GWG/GWA | GR SGC/RGA | HP CMC/CMT | IS AKC/AKT |
| AV GYC/GYT | RI AKA/ | NY WAC/WAT | DV GWC/GWT | | | | GS RGC/RGT | HY YAC/YAT | IT AYC/AYT |
| | RG SGC/RGA | | | | | | GV GKG/GKC | | IV RTC/RTT |
| | RP CSC/CST | | | | | | | | IK AWA/ |
| | RT ASA/ASG | | | | | | | | |
| | RL CKG/CKC | | | | | | | | |
| | RS MGC/NGT | | | | | | | | |

Single letter code
R = A or G
Y = C or T
K = G or T
S = C or G
W = A or T
H = A or C or T
B = C or G or T
V = A or C or G
D = A or G or T
N = A or C or G or T

FIGURE 13

The Genetic Code- First and Second Most Frequently Used Codons

| K<br>Lys | M<br>Met | F<br>Phe | P<br>Pro | S<br>Ser | T<br>Thr | W<br>Trp | Y<br>Tyr | V<br>Val | L<br>Leu |
|---|---|---|---|---|---|---|---|---|---|
| AAG/AAA | ATG/ | TTC/TTT | CCC/CCT | AGC/TCC | ACC/ACA | TGG/ | TAC/TAT | GTG/GTC | CTG/CTC |

The Genetic Code- First and Second Most Frequently Used Degenerate Codons For Two or More Amino Acids

TWO BASES AT A SINGLE POSITION

| | | | | | | | | | |
|---|---|---|---|---|---|---|---|---|---|
| KM AWG/ | MR AKT/ | FC TKC/TKT | PQ CMG/CMA | SW TSG/ | TM AYG/ | WR WGG/YGG | YN WAC/WAT | VM RTG/ | LM MYG/WTG |
| KN AAS/AAM | MI ATS/ATK | FI WTC/WTT | PH CMC/CMT | SN ARC/ART | TN AMC/AMT | WG KGG/ | YD KAC/KAT | VD GWC/GWT | LW TKG/ |
| KQ MAG/MAA | ML MTG/WTG | FL YTC/YTT | PA SCC/SCT | SL TYG/TYA | TK AMG/AMA | WS TSG/ | YC TRC/TRT | VE GWG/GWA | LS TYG/TYA |
| KE RAG/RAA | MK AWG/ | FS TYC/TYT | PR CSC/CST | SC WGC/WGT | TI AYC/AYT | WL TKG/ | YH YAC/YAT | VF KTC/KTT | LQ CWG/CWA |
| KR ARG/ARA | MT AYG/ | FY TYC/TWT | PL CYC/CYG | SF TYC/TYT | TA RCC/RCT | WC TGS/TGK | YF TWC/TWT | VI RTC/RTT | LH CWC/CWT |
| KT AMG/AMA | MV RTG/ | FV KTC/KTT | PS YCC/YCT | SY TMC/TMT | TR ASA/ASG | | YS TMC/TMT | VA GYC/GYT | LF YTC/YTT |
| KI AWA | | | PT MCC/MCT | SI AKC/AKT | TS ASC/WCC | | | VG GKG/GKC | LI MTC/MTT |
| | | | | SA KCC/KCT | | | | VL STG/STC | LP CYC/CYG |
| | | | | SG RGC/RGT | | | | | LV STG/STC |
| | | | | SP YCC/YCT | | | | | LR CKG/CKC |
| | | | | ST ASC/WCC | | | | | |
| | | | | SR MGC/MGT | | | | | |

Single letter code
R = A or G
Y = C or T
K = G or T
S = C or G
W = A or T
H = A or C or T
B = C or G or T
V = A or C or G
D = A or G or T
N = A or C or G or T FIGURE 13 (cont)

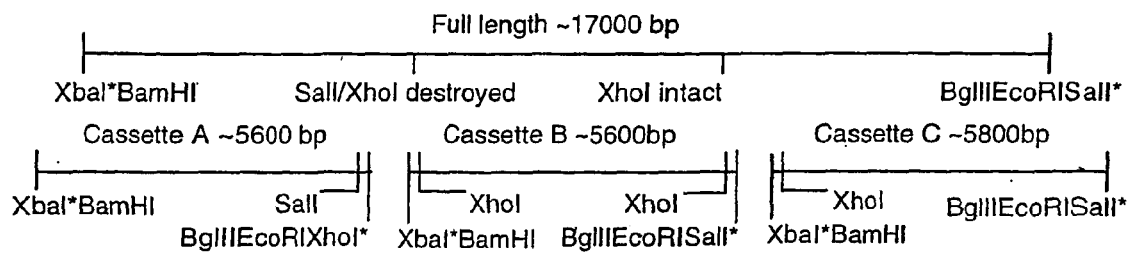

Full length construction after cloning the cassettes into pBS·
Sites marked with a "*" are in the pBS MCS

Cassette Extras (Can be removed from cassette ends)

```
A (37bp)      BamHI/Kozak Start              SalI   Stop BglII   EcoRI
         5' gc ggatccacc  atg......      ....gtcgac tga  agatct gaattc gc 3'
B (43bp)      BamHI/Kozak Start XhoI         XhoI   Stop BglII   EcoRI
         5' gc ggatccacc  atg  ctcgag...    ...ctcgag tga agatgt gaattc gc 3'
C (37bp)      BamHI/Kozak Start XhoI                Stop BglII   EcoRI
         5' gc ggatccacc  atg  ctcgag...    ........tga  agatct gaattc gc 3'
```

FIGURE 14

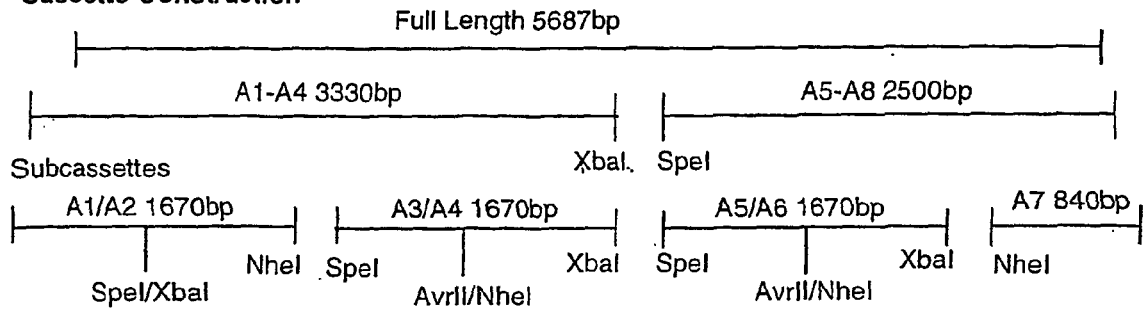

Cassette Construction

```
Subcassette Extras (Can be removed from cassette ends)
SC1 (A 28bp, B/C 34bp)                          SpeI      EcoRI
     As for 5' of Cassettes             ........actagt gaattc gc 3'
SC2 (28bp)       BamHI    XbaI                  NheI      EcoRI
     5'    gc ggatcc tctaga......       ........gctagc gaattc gc 3'
SC3 (28bp)       BamHI    SpeI                  AvrII     EcoRI
     5'    gc ggatcc actagt......       ........cctagg gaattc gc 3'
SC4 (28bp)       BamHI    NheI                  XbaI      EcoRI
     5'    gc ggatcc gctagc......       ........tctaga gaattc gc 3'
SC5 (28bp)       BamHI    SpeI                  AvrII     EcoRI
     5'    gc ggatcc actagt.......      ........ccatgg gaattc gc 3'
SC6 (28bp)       BamHI    NheI                  XbaI      EcoRI
     5'    gc ggatcc gctagc......       ........tctaga gaattc gc 3'
For Cassettes A and B only
SC7 (37bp)       BamHI    NheI
     5'    gc ggatcc gctagc......       As for 3' of Cassettes A/B
For Cassette C only
SC7 (28bp)       BamHI    NheI                  SpeI      EcoRI
     5'    gc ggatcc gctagc......       ........actagt gaattc gc 3'
SC8 (31bp)       BamHI    XbaI
     5'    gc ggatcc tctaga......       As for 3' of Cassette C
```

```
                Kozac
   BamHI          Start          30          40          env 185-214 (149)   70          80
      |            |  |           *           *                                *           *
GGGGGATCCACCATGACAGGCCCTTGCAMAAACGTCAGCWCCGTGCAATGCACACACGGAATCARACCCGTCGTGTCCAC
CCGCCTAGGTGGTACTGTCCGGGAACGTKTTTGCAGTCGWGGCACGTTACGTGTGTGCCTTAGTYTGGGCAGCACAGGTG
     M  T  G  P  C  X  N  V  S  X  V  Q  C  T  H  G  I  X  P  V  V  S  T>

90         100         110         120         130      gag 76-105 (6)   160
           *           *           *           *           *                         *
CCAACTGCTCCTGAATGGCTCCCTGARAAGCCTCTWCAATACCRTCGCCACACTGTGGTGCGTCCACCAAAGGATTGASG
GGTTGACGAGGACTTACCGAGGGACTYTTCGGAGAWGTTATGGYAGCGGTGTGACACCACGCAGGTGGTTTCCTAACTSC
   Q  L  L  L  N  G  S  L  X  S  L  X  N  T  X  A  T  L  W  C  V  H  Q . R  I  X>

170         180         190         200         210         220    pol 31-60 (36)
           *           *           *           *           *           *
TCARGGACACAAAGGAAGCCCTCGACAAAATCGAACTCGGCGATGGCGGAGGCGCTGAWAGGCAAGGCACCTCCAGCTCC
AGTYCCTGTGTTTCCTTCGGGAGCTGTTTTAGCTTGAGCCGCTACCGCCTCCGCGACTWTCCGTTCCGTGGAGGTCGAGG
   V  X  D  T  K  E  A  L  D  K  I  E  L  G  D  G  G  A  X  R  Q  G  T  S  S  S>

250         260         270         280         290         300         310         320
           *           *           *           *           *           *           *           *
YTCARCTTTCCACAAATCACACTGTGGCAAAGGCCTCTGGTCACGGAACCCTTCAGAAWAMAGAATCCCGAWATGGTGAT
RAGTYGAAAGGTGTTTAGTGTGACACCGTTTCCGGAGACCAGTGGCTTGGGAAGTCTTWTKTCTTAGGGCTWTACCACTA
   X  X  F  P  Q  I  T  L  W  Q  R  P  L  V  T  E  P  F  R  X  X  N  P  X  M  V  I> pol 316-345 (55)      350         360         370         380         390         400
                            *           *           *           *           *           *
TTACCAGTACATGGACGATCTGTATGTGGGAAGCGATCTGGAAATCGGACAGCATTTTACCACACCCGATAAGAAACACC
AATGGTCATGTACCTGCTAGACATACACCCTTCGCTAGACCTTTAGCCTGTCGTAAATGGTGTGGGCTATTCTTTGTGG
   Y  Q  Y  M  D  D  L  Y  V  G  S  D  L  E  I  G  Q  H  F  T  T  P  D  K  K  H>

410    pol 361-390 (58)       440         450         460         470         480
           *                            *           *           *           *           *
AAAAGGAACCACCATTCCTCTGGATGGGATACGAACTGCATCCCGATAGGTGGACCGTCCAGCCTYTTARTTTCCCTCAG
TTTTCCTTGGTGGTAAGGAGACCTACCCTATGCTTGACGTAGGGCTATCCACCTGGCAGGTCGGARAATYAAAGGGAGTC
   Q  K  E  P  P  F  L  W  M  G  Y  E  L  H  P  D  R  W  T  V  Q  P  X  X  F  P  Q>

490         500     pol 46-75 (37)    530         540         550         560
           *           *                        *           *           *           *
ATTACCCTCTGGCAGCGTCCCCTCGTGACARTCAAAATCGGCGGACAGCTCAWAGAGGCTCTGCTCGACACAGGGTCCYA
TAATGGGAGACCGTCGCAGGGGAGCACTGTYAGTTTTAGCCGCCTGTCGAGTWTCTCCGAGACGAGCTGTGTCCAGGRT
   I  T  L  W  Q  R  P  L  V  T  X  K  I  G  G  Q  L  X  E  A  L  L  D  T  G  S  X>

570         580         590    tat 46-75 (121)    620         630         640
           *           *           *                        *           *           *
TGGCAGAAAGAAACGTAGGCAACGTAGASGCGCTCCTCAGAGCAGMRAGGATCACCAATACCCTATCYCTGAGCAACCCC
ACCGTCTTTCTTTGCATCCGTTGCATCTSCGCGAGGAGTCTCGTCKYTCCTAGTGGTTATGGGATAGRGACTCGTTGGGG
   G  R  K  K  R  R  Q  R  R  X  A  P  Q  S  X  X  D  H  Q  Y  P  I  X  E  Q  P>

650         660         670         680    pol 1-30 (34)       710         720
           *           *           *           *                          *           *
TCYCCTTCTTTAGGGAAAACCTGGCTTTCCMGCAAGGTRAAGCCAGAGAGTTTYCCAGCGAACAGACARGAGCCAATAGC
AGRGGAAGAAATCCCTTTTGGACCGAAAGGKCGTTCCAYTTCGGTCTCTCAAARGGTCGCTTGTCTGTYCTCGGTTATCG
   L  X  F  F  R  E  N  L  A  P  X  Q  G  X  A  R  E  F  X  S  E  Q  T  X  A  N  S>

730         740         750     rev 106-122 (131)              spacers  800
           *           *           *                                        |
YCCRCCTCCAGGAAGAGCCCCCAAATCTCCGGCGAAAGCTCCGYCRTTCTGGGAYCTGGCACCAAAAAGGCGCT
RGGYGGAGGTCCTTCTCGGGGGTTTAGAGGCCGCTTTCGAGGCRGYAAGACCCTRGACCGTGGTTTTTCGCGA            A1
   X  X  S  R  K  S  P  Q  I  S  G  E  S  S  X  X  L  G  X  G  T  K  N  A  A  T  R>   join
                                                                                       A2
         810         820         830    gag 91-120 (7)    860         870         880
           *           *           *                       *           *           *
AGAATCGAWGTGARAGATACCAAAGAGGCTCTGGATAAGATTGAGGAGGWGCAAAASAAAAGCMAGCAAAAGACACAAC
TCTTAGCTWCACTYTCTATGGTTTCTCCGAGACCTATTCTAACTCCTCCWCGTTTTSTTTTCGKTCGTTTTCTGTGTTG
   R  I  X  V  X  D  T  K  E  A  L  D  K  I  E  E  X  Q  X  K  S  X  Q  K  T  Q>

890         900         910        920    pol 601-630 (74)   950         960
           *           *           *          *                        *           *
AGGCTGCCGCTAAAGCCGGATACGTCACCGATAGGGGAAGGCAAAAGRTTTRTCTCCCTGACAGAGACAACCAATCAGAAA
TCCGACGGCGATTTCGGCCTATGCAGTGGCTATCCCCTTCCGTTTTCYAAYAGAGGGACTGTCTSTGTTGGTTAGTCTTT
   Q  A  A  A  K  A  G  Y  V  T  D  R  G  R  Q  K  X  X  X  S  L  T  X  T  T  N  Q  K>
```

FIGURE 15 (Cont)

```
        970         980         990         1000        1010    env 46-75 (140)   1040
          *           *           *           *           *                          *
ACCGAACTGCAWGCCATTCAMGAMGCCRMTACCACACTGTTTTGCGCCAGCGATGCCAAAGCCYATGASACAGAGGTCCA
TGGCTTGACGTWCGGTAAGTKCTKCGGYKATGGTGTGACAAAACGCGGTCGCTACGGTTTCGGRTACTSTGTCTCCAGGT
  T   E   L   X   A   I   X   X   A   X   T   T   L   F   C   A   S   D   A   K   A   X   X   T   E   V   H>

1050        1060        1070        1080        1090     pol 76-105 (39)   1120
          *           *           *           *           *                          *
CAATGTGTGGGCCACACACGCTTGCGTCCCCGCTGACGATACAGTGCTGGAGGASATSAACCTCCCCGGAARATGGAAGC
GTTACACACCCGGTGTGTGCGAACGCAGGGGCGACTGCTATGTCACGACCTCCTSTASTTGGAGGGGCCTTYTACCTTCG
  N   V   W   A   T   H   A   C   V   P   A   D   D   T   V   L   E   X   X   N   L   P   G   X   W   K>

1130        1140        1150        1160        1170        1180        1190        1200
          *           *           *           *           *           *           *           *
CTAAGATGATTGGCGGAATCGGCGGATTCATTAAGGTGAGAARGATCGGACCCGAAAACCCTTACAATACCCCARTCTTC
GATTCTACTAACCGCCTTAGCCGCCTAAGTAATTCCACTCTTYCTAGCCTGGGCTTTTGGGAATGTTATGGGGTYAGAAG
  P   K   M   I   G   G   I   G   G   F   I   K   V   R   X   I   G   P   E   N   P   Y   N   T   P   X   F> pol 196-225 (47)   1230        1240        1250        1260        1270        1280
                      *           *           *           *           *           *
GCTATCAAGAAAAAGGACTCCACCAAATGGAGAAAGCTCGTGGATTTCAGRTTAGGATTATCAAWATCCTCTACCAAAG
CGATAGTTCTTTTTCCTGAGGTGGTTTACCTCTTTCGAGCACCTAAAGTCYAATCCTAATAGTTWTAGGAGATGGTTTC
  A   I   K   K   K   D   S   T   K   W   R   K   L   V   D   F   R   X   R   I   I   X   I   L   Y   Q   S>

1290    rev 16-45 (125)    1320        1330        1340        1350        1360
          *                          *           *           *           *           *
CAATCCCTATCCTAGCTCCGAAGGCWCCAGGCAARCCAGAARGAATAGGAGAAGGAGATGCGGAGGCGAACRGGRTAGGG
GTTAGGGATAGGATCGAGGCTTCCGWGGTCCGTTYGGTCTTYCTTATCCTCTTCCTCTACCCCTCCGCTTGYCCYATCCC
  N   P   Y   P   S   S   E   G   X   R   Q   X   R   X   N   R   R   R   R   W   G   G   E   X   X   R>

1370        1380    env 525-554 (171)   1410        1420        1430        1440
          *           *                            *           *           *           *
ATAGGTCCGTGAGACTGGTCARCGGATTCTYAGCCCTCGCCTGGGACGATCTGAGAACCTCTGCCTCTTCGAMAACCTC
TATCCAGGCACTCTGACCAGTYGCCTAAGATCGGGAGCGGACCCTGCTAGACTCTTYGGAGACGGAGAACCTKTTGGAG
  D   R   S   V   R   L   V   X   G   F   X   A   L   A   W   D   D   L   R   X   L   C   L   F   X   N   L>

1450        1460        1470    env 31-60 (139)    1500        1510        1520
          *           *           *                          *           *           *
TGGGTCACCGTCTACTATGGCGTCCCCGTCTGGAGAGASGCTRMCACAACCCTCTTCTGTGCCTCCGACGCTAAGGCTYA
ACCCAGTGGCAGATGATACCGCAGGGGCAGACCTCTCTSCGAYKGTGTTGGGAGAAGACACGGAGGCTGCGATTCCGART
  W   V   T   V   Y   Y   G   V   P   V   W   R   X   A   X   T   T   L   F   C   A   S   D   A   K   A   X> spacers             1550        1560     rev 1-30 (124)    1590        1600
                       *           *                          *           *
CGCTGCCATGGCTGGCAGAAGCGGCRRCACAGACGAAGAGCTCCTGARGGCTRTCAGAATCATTAASATTCTGTATCAGT
CCGACGGTACCGACCGTCTTCGCCGYYGTGTCTGCTTCTCGAGGACTYCCGAYAGTCTTAGTAATTSTAAGACATAGTCA
  A   A   M   A   G   R   S   G   X   T   D   E   E   L   L   X   A   X   R   I   I   X   I   L   Y   Q>

1610        1620        1630        1640        1650     vif 16-45 (101)   1680
          *           *           *           *           *                          *
CCAACCCTTACCCTTCAGTTAGATGARAATCAGAACCTGGAASAGCCTGGTCAAGCATCACATGYACATCTCCAAGAAA
GGTTGGGAATGGGAAGCATCATACTYTTAGTCTTGGACCTTSTCGGACCAGTTCGTAGTGTACRTGTAGAGGTTCTTT
  S   N   P   Y   P   S   A   S   M   X   I   R   T   W   X   S   L   V   K   H   H   M   X   I   S   K   K>

1690        1700        1710        1720        1730        1740        1750        1760
          *           *           *           *           *           *           *           *
GCCAAWGGCTGGTTCTATAGGCATCACTWTGASGAGTCCGAGSTCGTGARTCAGATTATCGAAVAGCTCATCAAAAAGGA
CGGTTWCCGACCAAGATATCCGTAGTGAWACTSCTCAGGCTCSAGCACTYAGTCTAATAGCTTBTCGAGTAGTTTTTCCT
  A   X   G   W   F   Y   R   H   H   X   X   E   S   E   X   V   X   Q   I   I   E   X   L   I   K   K   E> pol 661-690 (78)   1790        1800        1810        1820        1830        1840
                      *           *           *           *           *           *
AARGGTCTACCTAKCATGGGTACCAGCCCACAAGGGAATCGGACAAACCAAAGAGCTCCAGAAMCAGATTMYCAAAATCC
TTYCCAGATGGATMGTACCCATGGTCGGGTGTTCCCTTAGCCTGTTTGGTTTCTCGAGGTCTTKGTCTAAKRGTTTTAGG
  X   V   Y   L   X   W   V   P   A   H   K   G   I   G   Q   T   K   E   L   Q   X   Q   I   X   K   I>

1850    pol 916-945 (95)   1880        1890        1900        1910        1920
          *                          *           *           *           *           *
AAAACTTTAGGGTCTACTATAGGGATAGCAGAGACCCTMTCTGGAAGGGACCCAAAAGCYTTGAGGAAATCTGGRACAAT
TTTTGAAATCCCAGATGATATCCCTATCGTCTCTGGGAKAGACCTTCCCTGGGTTTTCGRAACTCCTTTAGACCYTGTTA
  Q   N   F   R   V   Y   Y   R   D   S   R   D   P   X   W   K   G   P   K   S   X   E   E   I   W   X   N>
```

FIGURE 15 (Cont)

A2 join A3

```
            1930    env 405-434 (163)   1960         1970        1980         1990        2000
               *                          *            *           *            *           *
ATGACATGGATKSAGTGGGAGAGAGAGATTAGCAATTACACAARCCWAATCTATRAGATTCTCARACCCGAACCCACAGC
TACTGTACCTAMSTCACCCTCTCTCTTAATCGTTAATGTGTTYGGWTTAGATAYTCTAAGACTYTGGGCTTGGGTGTCG
  M  T  W  X  X  W  E  R  E  I  S  N  Y  T  X  X  I  Y  X  I  L  X  P  E  P  T  A>

2010         2020    gag 451-480 (31)    2050         2060        2070         2080
         *            *                           *            *           *            *
CCCTCCCGCTGAGARTTTCRGATTCGGTGAGGAAACTACACCCTCCCMAAAGCAAGAGCMAAAGGATAAGGACCAATACG
GGGAGGGCGACTCTYAAAGYCTAAGCCACTCCTTTGATGTGGGAGGGKTTTCGTTCTCGKTTTCCTATTCCTCGTTATGC
  P  P  A  E  X  F  X  P  G  E  E  T  T  P  S  X  K  Q  E  X  K  D  K  E  Q  Y>

2090         2100        2110    pol 106-135 (41)    2140         2150        2160
         *            *           *                           *            *           *
ATCAGATTMTTATTGAGATTTGCGGCAAGAAAGCTATTGGTACAGTGCTCGTGGGACCTACCCCTGTGAATATCATTGGC
TAGTCTAAKAATAACTCTAAACGCCGTTCTTTCGATAACCATGTCACGAGCACCCTGGATGGGGACACTTATAGTAACCG
  D  Q  I  X  I  E  I  C  G  K  K  A  I  G  T  V  L  V  G  P  T  P  V  N  I  I  G>

2170         2180        2190        2200    vpr 46-75 (115)      2230        2240
         *            *           *           *                            *           *
AGAATTTACGAAACCTATGGCGATACCTGGGAGGGCGTCGAGGCTCTGATCAGAAYCCTCCAGCAACTGMTGTTTRTCCA
TCTTAAATGCTTTGGATACCGCTATGGACCCTCCCGCAGCTCCGAGACTAGTCTTRGGAGGTCGTTGACKACAAAYAGGT
  R  I  Y  E  T  Y  G  D  T  W  E  G  V  E  A  L  I  R  X  L  Q  Q  L  X  F  X  H>

2250         2260        2270        2280         2290    tat 31-61 (120)     2320
         *            *           *           *            *                           *
TTTCAGAATCGGATGTTWTCATTGCCAASTGTGTTTTCTCACCAAAGGTCTCGGCATTAGCYACGGAAGGAAAAAGAGAA
AAAGTCTTAGCCTACAAWAGTAACGGTTSACACAAAAGAGTGGTTTCCAGAGCCGTAATCGRTGCCTTCCTTTTTCTCTT
  F  R  I  G  C  X  H  C  Q  X  C  F  L  T  K  G  L  G  I  S  X  G  R  K  K  R>

2330         2340      spacers                  2370         2380    tat 1-30 (118)
         *            *                                   *            *
RACAGAGAAGGSGAGCTCCCCAAGCTGCCATGGACCCCGTGGACCCCAASCTGGAGCCTTGGAAWCACCCTGGCTCCCAG
YTGTCTCTTCCSCTCGAGGGGTTCGACGGTACCTGGGGCACCTGGGGTTGACCTCGGAACCTTWGTGGGACCGAGGGTC
  X  Q  R  R  X  A  P  Q  A  A  M  D  P  V  D  P  X  L  E  P  W  X  H  P  G  S  Q>

2410         2420        2430        2440         2450        2460        2470        2480
         *            *           *           *            *           *           *           *       ↑
CCTAMGACAGCCTGTWMCAAATGCTATTGCAAAAAGTGCCTAGCGAAGAGACAACCCCTAGCCMGAAACAGGAACMAA                      │
GGATKCTGTCGGACAWKGTTTACGATAACGTTTTTCACGGATCGCTTCTCTGTTGGGGATCGGKCTTTGTCCTTGKCTT                     A3
  P  X  T  A  C  X  K  C  Y  C  K  K  C  P  S  E  E  T  T  P  S  X  K  Q  E  X  K>                  join
                                                                                                      A4
    gag 466-495 (32)         2510        2520         2530        2540        2550         2560      │
                               *           *            *           *           *            *       ↓
AGACAAAGAACWCTACCCCCCTTYAGCCAGCCTCAAGTCCCTGTTTGGCAATGACAATTTCAATATGTGGAAGAATRACA
TCTGTTTCTTGWGATGGGGGGAARTCGGTCGGAGTTCAGGGACAAACCGTTACTGTTAAAGTTATACACCTTCTTAYTGT
  D  K  E  X  Y  P  P  X  A  S  L  K  S  L  F  G  N  D  N  F  N  M  W  K  N  X>

2570    env 91-120 (143)       2600         2610        2620        2630         2640
         *                              *            *           *           *            *
TGGTGGAMCAGATGCAMGAAGACRTTATCTCACTATGGGACCAAAGCCTCAAGCCTTGCGTCAACCTCGACGTCGGCGAT
ACCACCTKGTCTACGTKCTTCTGYAATAGAGTGATACCCTGGTTTCGGAGTTCGGAACGCAGTTCGAGCTGCAGCCGCTA
  M  V  X  Q  M  X  E  D  X  I  S  L  W  D  Q  S  L  K  P  C  V  K  L  D  V  G  D>

2650         2660    pol 256-285 (51)        2690         2700        2710         2720
         *            *                               *            *           *            *
GCCTATTTCTCCGTGCCTCTGGATRAARRCTTCAGAAAGTATACCGCTTTCACAATCCCTAGCAYAAACAATGACCAACT
CGGATAAAGAGGCACGGAGACCTAYTTYYGAAGTCTTTCATATGGCGAAAGTGTTAGGGATCGTRTTTGTTACTGGTTGA
  A  Y  F  S  V  P  L  D  X  X  F  R  K  Y  T  A  F  T  I  P  S  X  N  N  E  Q  L>

2730         2740        2750    pol 751-780 (84)         2780        2790         2800
         *            *           *                               *            *           *
GAAAGGCGAAGCCATSCATGGCCAAGTGRATTGCTCACCAGGCATTTGGCAACTGGATTGCACACACCTGGAGGGAAAGR
CTTTCCGCTTCGGTASGTACCGGTTCACYTAACGAGTGGTCCGTAAACCGTTGACCTAACGTGTGTGGACCTCCCTTTCY
  K  G  E  A  X  H  G  Q  V  X  C  S  P  G  I  W  Q  L  D  C  T  H  L  E  G  K>

2810        2820        2830        2840    pol 166-195 (45)       2870        2880
         *           *           *           *                               *           *
TTATCCCTAAGGTCAAGCAATGGCCTCTGACAGAGGAAAAGATTAAGGCTCTGACTGMGATTTGCAMAGAGATGGAGVAA
AATACGGATTCCAGTTCGTTACCGGAGACTGTCTCCTTTTCTAATTCCGAGACTGACKCTAAACGTKTCTCTACCTCBTT
  X  I  P  K  V  K  Q  W  P  L  T  E  E  K  I  K  A  L  T  X  I  C  X  E  M  E  X>
```

FIGURE 15 (Cont)

```
              2890       2900       2910    pol 331-360 (56)   2940       2950       2960
                *          *          *                          *          *          *
GAGGGAAAGATTAGCATGGATGACCTCTACGTCGGCTCCGACCTGGAGATTGGCCAACATAGGRCCAAAATCGAAGAGCT
CTCCCTTTCTAATCGTACCTACTGGAGATGCAGCCGAGGCTGGACCTCTAACCGGTTGTATCCYGGTTTTAGCTTCTCGA
  E  G  K  I  S  M  D  D  L  Y  V  G  S  D  L  E  I  G  Q  H  R  X  K  I  E  E  L>

2970       2980       2990       3000    pol 616-645 (75)   3030       3040
                *          *          *          *                          *          *
CAGGSMACACCTCCTGARATGGGGACTCACCGAMACCACAAACCAAAAGACTGAGCTCCAMGCTATCCAWCTGGCTCTGC
GTCCSKTGTGGAGGACTYTACCCCTGAGTGGCTKTGGTGTTTGGTTTTCTGACTCGAGGTKCGATAGGTWGACCGAGACG
  R  X  H  L  L  X  W  G  L  T  X  T  T  N  Q  K  T  E  L  X  A  I  X  L  A  L>

- 3050       3060       3070       3080       3090    pol 796-825 (87)   3120
                *          *          *          *          *                          *
.AAGACTCCGGCTYAGAGGTCAACATTGTGACAGACATTCCCGCTGAGACTGGTCAAGAGACCGCCTATTTCMTTCTGAAA
 TTCTGAGGCCGARTCTCCAGTTGTAACACTGTCTGTAAGGGCGACTCTGACCAGTTCTCTGGCGGATAAAGKAAGACTTT
  Q  D  S  G  X  E  V  N  I  V  T  D  I  P  A  E  T  G  Q  E  T  A  Y  F  X  L  K>

3130       3140       3150       3160       3170       3180       3190       3200
                *          *          *          *          *          *          *          *
CTGGCTGGCAGATGGCCTGTGARARYCATTCACACAGACAATGGCAGGACAAAGATTGAGGAACTGAGASMGCATCTGCT
.GACCGACCGTCTACCGGACACTYTYRGTAAGTGTGTCTGTTACCGTCCTGTTTCTAACTCCTTGACTCTSKCGTAGACGA
  L  A  G  R  W  P  V  X  X  I  H  T  D  N  G  R  T  K  I  E  E  L  R  X  H  L  L> pol 346-375 (57)   3230       3240       3250       3260       3270       3280
                             *          *          *          *          *          *
CARATGGGGCTTCACAACCCCTGACAAAAAGCATCAGAAAGAGCCTCCCTTTCT[ ]GTCAAGAAACTGACAGAGG
GTYTACCCCGAAGTGTTGGGGACTGTTTTTCGTAGTCTTTCTCGGAGGGAAAGA[ ]CAGTTCTTTGACTGTCTCC
  X  W  G  F  T  T  P  D  K  K  H  Q  K  E  P  P  F  L  S  S  V  K  K  L  T  E>

3290   vif 166-192 (111)   3320       3330         spacers          3360
                *                          *          *                             *
ATARGTGGAACRAACCCCAGAAAAYCAAGGGACRCAGAGRAAATCACACAATGAATGGCCATGCTGCCACAGAGTCCCAG
TATYCACCTTGYTTGGGGTCTTTTRGTTCCCTGYGTCTCYTTTAGTGTGTTACTTACCGGTACGACGGTGTCTCAGGGTC
  D  X  W  N  X  P  Q  K  X  R  G  X  R  X  N  H  T  M  N  G  H  A  A  T  E  S  Q>

3370       3380    env 435-464 (165)   3410       3420       3430       3440
                *          *                          *          *          *          *
AATCAGCAAGACAGAAACGAAMAGGAMCTGCTGGMGCTCGACAAATGGGCAAGCCTCTGGAATTGGTTTTACATTASCCA
TTAGTCGTTCTGTCTTTGCTTKTCCTKGACGACCKCGAGCTGTTTACCCGTTCGGAGACCTTAACCAAAYTGTAATSGCT
  N  Q  Q  D  R  N  E  X  X  L  L  X  L  D  K  W  A  S  L  W  N  W  F  X  I  X  D>

3450       3460       3470    gag 121-150 (9)   3500       3510       3520
                *          *          *                          *          *          *
CACCGGAAARTAGCTCCMAAGTGTCCCAGAATTACCCTATCGTCCAGAATSYCCAAGGCCAAATGGTCCACCAASCCMTCT
GTGGCCTTYATCGAGGKTTCACAGGGTCTTAATGGGATAGCAGGTCTTASRGGTTCCGGTTTACCAGGTGGTTSGGKAGA
  T  G  X  S  S  X  V  S  Q  N  Y  P  I  V  Q  N  X  Q  G  Q  M  V  H  Q  X  X>

3530       3540       3550       3560    env 480-509 (168)   3590       3600
                *          *          *          *                          *          *
CCCCCAGACTCRTCGGACTGAGAATCRTTTTCGCTGTGCTCAGCATTRTCAATAGGGTCAGGCAAGGCTATAGCCCTCTG
GGGGGTCTGAGYAGCCTGACTCTTAGYAAAAGCGACACGAGTCGTAAYAGTTATCCCAGTCCGTTCCGATATCGGGAGAC
  S  P  R  L  X  G  L  R  I  X  F  A  V  L  S  I  X  N  R  V  R  Q  G  Y  S  P  L>

3610       3620       3630       3640       3650    vif 106-135 (107   3680
                *          *          *          *          *                          *
TCCTTCCAAACCCTCMYCCTCATCCATCTGYAWTACTTTGACTGTTTCKCTGACTCCRCCATTAGGAGAGCCATCCTGGG
AGGAAGGTTTGGGAGKRGGAGTAGGTAGACRTWATGAAACTGACAAAGMGACTGAGGYGGTAATCCTCTCGGTAGGACCC
  S  F  Q  T  L  X  L  I  H  L  X  Y  F  D  C  F  X  D  S  X  I  R  R  A  I  L  G>

3690       3700       3710       3720       3730       3740       3750       3760
                *          *          *          *          *          *          *          *
ACASAKAGTGAGMAGGAGATGCGAATACGCTGTGGGAMTCGGAGCCATGWTCYTTGGCTTTCTGGGTGCCGCTGGCTCCA
TGTSTMTCACTCKTCCTCTACGCTTATCGACACCCTKAGCCTCGGTACWAGRAACCGAAAGACCCACGGCGACCGAGGT
  X  X  X  V  X  R  R  C  E  Y  A  V  G  X  G  A  M  X  X  G  F  L  G  A  A  G  S> env 300-329 (156)   3790       3800       3810       3820       3830       3840
                              *          *          *          *          *          *
CCATGGGCGCTGCCTCCATSACACTGACAGTGCAAGCCTATGACCCTAGCAAAGACCTCRTTGCTGAGATTCAGAAACAG
GGTACCCGCGACGGAGGTASTGTGACTGTCACGTTCGGATACTGGGATCGTTTCTGGAGYAACGACTCTAAGTCTTTGTC
  T  M  G  A  A  S  X  T  L  T  V  Q  A  Y  D  P  S  K  D  L  X  A  E  I  Q  K  Q>
```

```
pol 466-495 (65)    3870      3880      3890      3900      3910      3920
GGTCAGGRTCAGTGGACATWTCAGATTTWCCAAGAGCCTTTCAAAAAGGAACCGTCCTGGTCGGCCCTACACCCGTCAA
CCAGTCCYAGTCACCTGTAWAGTCTAAAWGGTTCTCGGAAAGTTTTTCCCTTGGCAGGACCAGCCGGGATGTGGGCAGTT
 G  Q  X  Q  W  T  X  Q  I  X  Q  E  P  F  K  N  G  T  V  L  V  G  P  T  P  V  N>

3930    pol 121-150 (42)   3960      3970      3980      3990      4000
CATCATCGGAAGGAACMTGCTGACACAGMTTGGCYGCACCCTCAACTTTCCCATTAGCAAAGGCAGCCCTGCTATCTTTC
GTAGTAGCCTTCCTTGKACGACTGTGTCKAACCGRCGTGGGAGTTGAAAGGGTAATCGTTTCCGTCGGGACGATAGAAAG
 I  I  G  R  N  X  L  T  Q  X  G  X  T  L  N  F  P  I  S  K  G  S  P  A  I  F>

4010      4020    pol 301-330 (54)     4050      4060      4070      4080
AGTCCAGCATGMCAMAGATTCTGGAGCCTTTTAGGAWAMAAAACCCTGASATGGTCATCTATCAGTATCCTAGCCCTCTG
TCAGGTCGTACKGTKTCTAAGACCTCGGAAAATCCTWTKTTTTGGGACTSTACCAGTAGATAGTCATAGGATCGGGAGAC
 Q  S  S  M  X  X  I  L  E  P  F  R  X  X  N  P  X  M  V  I  Y  Q  Y  P  S  P  L>

4090      4100      4110      nef 136-165 (188)    4140      4150      4160
ACATTCGGATGGTGTTTCAAACTGGTCCCCGTGGACCCCAGSGAAGTGGAAGAGRYCAACRAGGGCGAAAACAATTGCCT
TGTAAGCCTACCACAAAGTTTGACCAGGGGCACCTGGGGTCSCTTCACCTTCTCYRGTTGYTCCCGCTTTTGTTAACGGA
 T  F  G  W  C  F  K  L  V  P  V  D  P  X  E  V  E  E  X  N  X  G  E  N  N  C  L>

4170      4180      4190      4200    pol 271-300 (52)    4230      4240
CCTCTTTAGGAAAATACACAGCCTTTACCATTCCCTCCAYCAATAACGAAACCCCTGGCATTAGGTATCAGTATAACGTCC
GGAGAAATCCTTTATGTGTCGGAAATGGTAAGGGAGGTRGTTATTGCTTTGGGGACCGTAATCCATAGTCATATTGCAGG
 L  F  R  K  Y  T  A  F  T  I  P  S  X  N  N  E  T  P  G  I  R  Y  Q  Y  N  V>

4250      4260      4270      4280      4290    env 315-344 (157)    4320
TGCCTCAGGGATGGGGAAGCACAATGGGAGCCGCCAGCATKACCCTCACCGTCCAGGCTAGGCWACTGCTCAGCGGAATC
ACGGAGTCCCTACCCCTTCGTGTTACCCTCGGCGGTCGTAMTGGGAGTGGCAGGTCCGATCCGWTGACGAGTCGCCTTAG
 L  P  Q  G  W  G  S  T  M  G  A  A  S  X  T  L  T  V  Q  A  R  X  L  L  S  G  I>

4330      4340      4350      4360      4370    pol 451-480 (64)    4400
GTCCAGCAACAGARCAATCTGCTGMGGAGAATAGGGAAATCCTCARAGAGCCTGTGCATGGCGTCTACTACGATCCCTC
CAGGTCGTTGTCTYGTTAGACGACKCCTCTTATCCCTTTAGGAGTYTCTCGGACACGTACCGCAGATGATGCTAGGGAG
 V  Q  Q  Q  X  N  L  L  X  E  N  R  E  I  L  X  E  P  V  H  G  V  Y  Y  D  P  S>

4410      4420      4430      4440      4450    vpu 61-81 (136)    4480
CAAGGATCTGRTCGCTGAARTCCAAAAGCAAGGCASAGAGGAACTGTCCRCCWTGGTGGATATGGGAAACTACGACCTCG
GTTCCTAGACYAGCGACTTYAGGTTTTCGTTCCGTSTCTCCTTGACAGGYGGWACCACCTATACCCTTTGATGCTGGAGC
 K  D  L  X  A  E  X  Q  K  Q  G  X  E  E  L  S  X  X  V  D  M  G  N  Y  D  L> spacers    4510      4520      4530      vpr 61-90 (116)    4560
GAGTGGACAATAACCTGGCCGCTATTAGAAYCCTGCAACAGCTCMTGTTCRTTCACTTTAGGATTGGCTGCCRGCACTCC
CTCACCTGTTATTGGACGGCGATAATCTTRGGACGTTGTCGAGKACAAGYAAGTGAAATCCTAACCGACGGYCGTGAGG
 G  V  D  N  N  L  A  A  I  R  X  L  Q  Q  L  X  F  X  H  F  R  I  G  C  X  H  S>

4570      4580      4590      4600      4610    gag 406-435 (28)    4640
AGGATTGGCATCMYCCGTCAGAGAAGGGSCAGAGCTCCCAGGAAAAAGGGATGCTGGAAGTGTGGCARAGAGGGACACCA
TCCTAACCGTAGKRGGCAGTCTCTTCCCSGTCTCGAGGGTCCTTTTTCCCTACGACCTTCACACCGTYTCTCCCTGTGGT
 R  I  G  I  X  R  Q  R  R  X  R  A  P  R  K  K  G  C  W  K  C  G  X  E  G  H  Q>

4650      4660      4670      4680      4690      4700      4710      4720
GATGAAGGATTGCACTGAGAGACAGGCTAACTTTCTGGGAAAGGAWGCCAGACTGRTTATCARAACCTATTGGGGACTGC
CTACTTCCTAACGTGACTCTCTGTCCGATTGAAAGACCCTTTCTWCGGTCTGACYAATAGTYTTGGATAACCCCTGACG
 M  K  D  C  T  E  R  Q  A  N  P  L  G  K  X  A  R  L  X  I  X  T  Y  W  G  L> vif 61-90 (104)    4750      4760      4770      4780      4790      4800
ATACCGGTGAGAGAGACTGGCASCTCGGCCAWGGCGTCAGCATTGAGTGGAGCAYAAGGGAAAGGGCTGAGGATAGCGGC
TATGGCCACTCTCTCTGACCGTSGAGCCGGTWCCGCAGTCGTAACTCACCTCGTRTTCCCTTTCCCGACTCCTATCGCCG
 H  T  G  E  R  D  W  X  L  G  X  G  V  S  I  E  W  R  X  R  E  R  A  E  D  S  G>
```

A5 join A6

```
          vpu 46-75 (135)        4830       4840       4850       4860       4870       4880
                                   *          *          *          *          *          *
AACGAAAGCGAAGGCGACASAGAAGAGCTCAGCRCAWTGGTGGACATGGGCAATTACGATCTGTCTAGCCCTGCCCCCAG
TTGCTTTCGCTTCCGCTGTSTCTTCTCGAGTCGYGTWACCACCTGTACCCGTTAATGCTAGACAGATCGGGACGGGGGTC
  N  E  S  E  G  D  X  E  E  L  S  X  X  V  D  M  G  N  Y  D  L  S  S  P  A  P  R>

4890       env 510-539 (170)    4920       4930       4940       4950       4960
       *          *          *          *          *          *          *
GGGACCCGATAGGCYGGRGRGAATCGAAGAGGAAGGCGGAGAGCRAGRCAGAGRCAGAAGCGTCAGGCTCGTGARTGGCA
CCCTGGGCTATCCGRCCYCYCTTAGCTTCTCCTTCCGCCTCTCGYTCYGTCTCYGTCTTCGCAGTCCGAGCACTYACCGT
   G  P  D  R  X  X  X  I  E  E  E  G  G  E  X  X  R  X  R  S  V  R  L  V  X  G>

4970       4980       nef 151-180 (189)   5010       5020       5030       5040
       *          *          *                  *          *          *          *
GWGAGGTCGAGGAARYCAATRAGGGAGAGAATAACTGTCTGCTCCACCCTATSRGTCWACATGGCATGGAAGACGAAGAS
CWCTCCAGCTCCTTYRGTTAYTCCCTCTCTTATTGACAGACGAGGTGGGATASYCAGWTGTACCGTACCTTCTGCTTCTS
   X  E  V  E  E  X  N  X  G  E  N  N  C  L  L  H  P  X  X  X  H  G  M  E  D  E  X>

5050       5060       5070   pol 961-990 (98)   5100       5110       5120
       *          *          *                        *          *          *
AGAGAGGTCAATAGCGATATCAAAGTGGTCCCCAGAAGGAAAGCCAAAATCATTAGGGATTACGGAAAGCAAATGGCTGG
TCTCTCCAGTTATCGCTATAGTTTCACCAGGGGTCTTCCTTTCGGTTTTAGTAATCCCTAATGCCTTTCGTTTACCGACC
  R  E  V  N  S  D  I  K  V  V  P  R  R  K  A  K  I  I  R  D  Y  G  K  Q  M  A  G>

5130       5140       5150       5160    pol 16-45 (35)    5190       5200
       *          *          *          *                        *          *
CGMTGACTGTGTGGCCRGCTTCYCTTCCGAGCAAACARGGGCTAACTCCYCTRCAAGCAGAAAGCTGGGAGACGGAGGCG
GCKACTGACACACCGGYCGAAGRGAAGGCTCGTTTGTYCCCGATTGAGGRGAYGTTCGTCTTCGACCCTCTGCCTCCGC
  X  D  C  V  A  X  F  X  S  E  Q  T  X  A  N  S  X  X  S  R  K  L  G  D  G  G>

5210       5220       5230       5240       5250  gag 390-420 (27)   5280
       *          *          *          *          *                        *
GAGCCGASAGACAGGGAACAAGCTCCAGCTGTTTCAATTGCGGCAAAGAGGGACACMTTGCCARAAACTGTAGGGCCCCT
CTCGGCTSTCTGTCCCTTGTTCGAGGTCGACAAAGTTAACGCCGTTTCTCCCTGTGKAACGGYTYTTGACATCCCGGGGA
  G  A  X  R  Q  G  T  S  S  S  C  F  N  C  G  K  E  G  H  X  A  X  N  C  R  A  P>

5290       5300       5310       5320       5330       5340       5350       5360
       *          *          *          *          *          *          *          *
CGCAAGAAAGGTTGTTGGAAATGCGGAARGGAAGGCCATCAAATGAAAGACTGTACCGAAAGGCAAGCCAATTTCCTCGG
GCGTTCTTTCCAACAACCTTTACGCCTTYCCTTCCGGTAGTTTACTTTCTGACATGGCTTTCCGTTCGGTTAAAGGAGCC
  R  K  K  G  C  W  K  C  G  X  E  G  H  Q  M  K  D  C  T  E  R  Q  A  N  F  L  G> gag 421-450 (29)    5390       5400       5410       5420       5430       5440
                       *          *          *          *          *          *
CAAAATCTGGCCCTCCMRCAAAGGCAGACCCGGAAACTTTTCYCCAAAGCAAMTGGCTCTGGTATATCAAAATCTTTATCA
GTTTTAGACCGGGAGGKYGTTTCCGTCTGGGCCTTTGAAAGRGGTTTCGTTKACCGAGACCATATAGTTTTAGAAATAGT
  K  I  W  P  S  X  K  G  R  P  G  N  P  X  Q  S  X  W  L  W  Y  I  K  I  F  I>

5450       env 465-494 (167)   5480       5490       5500       5510       5520
       *          *          *          *          *          *          *
TGATCGTCGGTGGACTGRTTGGCCTCAGGATTRTCTTTGCCGTCCTGTCCATCRTTAACGGAGCCGYGAGCCRAGACCTC
ACTAGCAGCCACCTGACYAACCGGAGTCCTAAYAGAAACGGCAGGACAGGTAGYAATTGCCTCGGCRCTCGGYTCTGGAG
  M  I  V  G  G  L  X  G  L  R  I  X  F  A  V  L  S  I  X  N  G  A  X  S  X  D  L>

5530       5540       nef 31-60 (181)   5570       5580       spacers
       *          *          *                  *          *
GATAAACATGGCGCTMTTACAAGCTCCAATACCSCTGCCAATAACSCTGACTGTGYCTGGCTGRAGGCTGCTGCCATGAC
CTATTTGTACCGCGAKAATGTTCGAGGTTATGGSGACGGTTATTGSGACTGACACRGACCGACYTCCGCGACGGTACTG
  D  K  H  G  A  X  T  S  S  N  T  X  A  N  N  X  D  C  X  W  L  X  A  A  A  M  T>

5610       5620       5630    vpu 1-30 (132)   5660       5670       5680
       *          *          *                        *          *          *
ACCCCTGGAGATCATCGCTATCGTCGCCYTTATCGTCGCCCTCATCMTAGCCATTGTGGTCTGGACAATCGYCTWCATTG
TGGGGACCTCTAGTAGCGATAGCAGCGGRAATAGCAGCGGGAGTAGKATCGGTAACACCAGACCTGTTAGCRGAWGTAAC
  P  L  E  I  I  A  I  V  A  X  I  V  A  L  I  X  A  I  V  V  W  T  I  X  X  I>

5690       5700       5710       5720    pol 136-165 (43)   5750       5760
       *          *          *          *                        *          *
AGTATGGAGAAATMTGCTCACCCAAMTCGGAYGCACACTGAATTTCCCTATCTCCCCCATTGASACAGTGCCTGTGAAA
TCATACCTCTTTAKACGAGTGGGTTKAGCCTRCGTGTGACTTAAAGGGATAGAGGGGGTAACTSTGTCACGGACACTTT
  E  Y  V  E  N  X  L  T  Q  X  G  X  T  L  N  F  P  I  S  P  I  X  T  V  P  V  K>
```

FIGURE 15 (Cont)

```
              5770       spacers       5800        5810           env 255-284 (153)    5840
                *            *           *           *             *          *          *
    CTGAAACCCGGAATGGATGGCGCCGCAYCTTTAGGCCTGGCGGAGGCRATATSARAGACAATTGGAGAAGCGAACTGTA
    GACTTTGGGCCTTACCTACCGCGGCGGTRGAAATCCGGACCGCCTCCGYTATASTYTCTGTTAACCTCTTCGCTTGACAT
        L  K  P  G  M  D  G A  A  X  F  R  P  G  G  G  X  X  X  D  N  W  R  S  E  L  Y>

5850      5860      5870       5880      5890      5900      5910      5920
           *         *         *          *         *         *         *         *
    TAAGTATAAGGTCGTGRAGATTRAGCCTCTGGGARTCACATGGATTCCCGAATGGGAGTTCGTCAACACACCCCCACTGG
    ATTCATATTCCAGCACYTCTAAYTCGGAGACCCTYAGTGTACCTAAGGGCTTACCCTCAAGCAGTTGTGTGGGGGTGACC
        K  Y  K  V  V  X  I  X  P  L  G  X  T  W  I  P  E  W  E  F  V  N  T  P  P  L> pol 556-585 (71)     5950      5960      5970      5980      5990      6000
                                 *         *         *         *         *         *
    TCAAGCTATGGTATCAGCTGGAGAAAGASCCTATCGYTGGCCGYTGACCTCAGGATCTCAACAYGATGCTGAATAYTGTA
    AGTTCGATACCATAGTCGACCTCTTTCTSGGATAGCRACCGCRACTGGAGTCCTAGAGTTGTRCTACGACTTATRACAT
        V  K  L  W  Y  Q  L  E  K  X  P  I  K  G  X  E  P  Q  D  L  N  X  M  L  N  X  V>

6010    gag 181-210 (13)    6040      6050      6060      6070      6080
                *          *                *         *         *         *         *
    GGAGGCCATCAGGCCGCTATGCAAATGCTGAAAGASACAATCAATGAGGAAGCCGCTGTCCTGTTTCTGGATGGCATTRA
    CCTCCGGTAGTCCGGCGATACGTTTACGACTTTCTSTGTTAGTTACTCCTTCGGCGACAGGACAAAGACCTACCGTAAYT
        G  G  H  Q  A  A  M  Q  M  L  K  X  T  I  N  E  E  A  A  V  L  F  L  D  G  I  X>

6090      6100     pol 706-735 (81)   6130      6140      6150      6160
           *         *             *             *         *         *         *
    CAAAGCTCAAGAGGAACATGAGARGTATCACTCCAACTGGAGGACAATGGCCARCGAMTTTAATCTCMTGAAGCATMTCG
    GTTTCGAGTTCTCCTTGTACTCTYCATAGTGAGGTTGACCTCCTGTTACCGGTYGCTKAAATTAGACKACTTCGTAKAGC
        K  A  Q  E  E  H  E  X  Y  H  S  N  W  R  T  M  A  X  X  P  N  L  X  K  H  X>

6170      6180      6190        gag 31-60 (3)    6220      6230      6240
           *         *         *               *            *         *         *
    TCTGGGCCTCTAGGGAGCTGGAGAGATTCGCTCTGAATCCCRGCCTGCTGGAGACAKCCGAAGGCTGTMAGCAAATTGCT
    AGACCCGGAGATCCCTCGACCTCTCTAAGCGAGACTTAGGGYCGGACGACCTCTGTMGGCTTCCGACAKTCGTTTAACGA
        V  W  A  S  R  E  L  E  R  F  A  L  N  P  X  L  L  E  T  X  E  G  C  X  Q  I  A>

6250      6260      6270       6280    env 215-244 (151)    6310      6320
           *         *         *          *            *              *         *
    GAGGAAGAGATTATCATTAGGTCCGAGAAATYTCACARACAATGYCAAAACCATTATCGTCCAMCTCAACRAAAGCGTCGW
    CTCCTTCTCTAATAGTAATCCAGGCTCTTARAGTGTYTGTTACRGTTTTGGTAATAGCAGGTKGAGTTGYTTTCGCAGCW
        E  E  E  I  I  I  R  S  E  N  X  T  X  N  K  K  T  I  I  V  X  L  N  X  S  V  X>

6330      6340      6350       6360      6370    gag 1-30 (1)       6400
           *         *         *          *         *         *                 *
    GATTAACATGGGCGCTAGGGCTAGTGTCCTCAGMGGCGGCRAGCTGGACGCCTGGGAAAAGATTAGGCTCAGGCCTGGCG
    CTAATTGTACCCGCGATCCCGATCACAGGAGTCKCCGCCGYTCGACCTGCGGACCCTTTTCTAATCCGAGTCCGGACCGC
        I  N  M  G  A  R  A  S  V  L  X  G  G  X  L  D  A  W  E  K  I  R  L  R  P  G>

6410      6420      6430       6440      6450     nef 91-120 (185)    6480
           *         *         *          *         *            *               *
    GAAAGAAAAAGTATAGGCTCAAGGAGAAGGGAGGCCTGGASGGACTGRTTTTACTCCAAAAAGAGGCAAGASATTCTGGAT
    CTTTCTTTTTCATATCCGAGTTCCTCTTCCCTCCGGACCTSCCTGACYAAATGAGGKTTTTCTCCGTTCTSTAAGACCTA
        G  K  K  K  Y  R  L  K  E  K  G  G  L  X  G  L  X  Y  S  X  K  R  Q  X  I  L  D>

6490      6500      6510       6520      6530      6540      6550      6560
           *         *         *          *         *         *         *         *     B1
    CTGTGGGTGTATMACACACAGGGATTCASTAGATGGGGAACCWTGATCCTCGGCWTGGTGATKATCTGTAGCGCCAGCGA  join
    GACACCCACATAKTGTGTGTCCCTAAGTSATCTACCCCTTGGWACTAGGAGCCGWACCACTAMTAGACATCGCGGTCGCT  B2
        L  W  V  Y  X  T  Q  G  F  T  R  W  G  T  X  I  L  G  X  V  X  I  C  S  A  S  X> env 16-45 (138)   6590     6600      6610      6620      6630      6640
                   *           *         *         *         *         *         *
    SAATCTGTGGGTGACAGTGTATTACGGAGTGCCTGTGTGGAGGAGACWGCTCCTGTCCGGCATTGTGCAACAGCAAARTA
    STTAGACACCCACTGTCACATAATGCCTCACGGACACACCTCCTCTGWCGAGGACAGGCCGTAACACGTTGTCGTTTYAT
        N  L  W  V  T  V  Y  Y  G  V  P  V  W  R  R  X  L  L  S  G  I  V  Q  Q  Q  X>

6650   env 330-359 (158)    6680      6690      6700      6710      6720
              *             *             *         *         *         *         *
    ACCTCCTGAGGGCTATCGAAGCCCAACAGCATCTGCTCCAGCTCACCGTCTGGGTCAGGCATTTCCCCAGGCCTTGGCTC
    TGGAGGACTCCCGATAGCTTCGGGTTGTCGTAGACGAGGTCGAGTGGCAGACCCAGTCCGTAAAGGGGTCCGGAACCGAG
        N  L  L  R  A  I  E  A  Q  Q  H  L  L  Q  L  T  V  W  V  R  H  P  P  R  P  W  L>
```

FIGURE 15 (Cont)

vpr 31-60 (114)

```
         6750      6760      6770      6780      6790       6800
          *         *         *         *         *          *
CACRRCCTGGGACAGYACATCTATGAGACATACGGAGACACATGGKMGGGAGTGGAAGCCCTCAMAGCCCTCATCAMACC
GTGYYGGACCCTGTCRTGTAGATACTCTGTATGCCTCTGTGTACCMKCCCTCACCTTCGGGACTKTCGGGAGTAGTKTGG
  H   X   L   G   Q   X   I   Y   E   T   Y   G   D   T   W   G   V   E   A   L   X   A   L   I   X   P>
``` vif 151-180 (110)

```
  6810                6840      6850      6860      6870      6880
   *                   *         *         *         *         *
CAAAAAGATTARGCCTCCCCTCCCATCCGTGAAAAAGCTCACCGAAGACARATGGAATRAGCCTCAAAAGAYATATAGCG
GTTTTTCTAATYCGGAGGGGAGGCTAGGCACTTTTTCGAGTGGCTTCTGTYTACCTTAYTCGGAGTTTTCTRIATATCGC
  K   K   I   X   P   P   L   P   S   V   K   K   L   T   E   D   X   W   N   X   P   Q   K   X   Y   S>
``` pol 901-930 (94)

```
  6890      6900              6930      6940      6950      6960
   *         *                 *         *         *         *
CTGGCGAAAGGATTRTCGATATCATTGCAWCCGACATTCAGACTAAGGAACTGCAAAASCAAATCMYAAAGATTCAGAAT
GACCGCTTTCCTAAYAGCTATAGTAACGTWGGCTGTAAGTCTGATTCCTTGACGTTTTSGTTTAGKRTTTCTAAGTCTTA
  A   G   E   R   I   X   D   I   I   A   X   D   I   Q   T   K   E   L   Q   X   Q   I   X   K   .   I   Q   N>
``` pol 886-915 (93)

```
  6970      6980      6990               7020      7030      7040
   *         *         *                  *         *         *
TTCGCTGTGTTTATCCATAACTTTAAGAGGAAGGGAGGCATTGGCGGCTACTCCGCCGGAGAGAGAATCRTTGACATTAT
AACCGACACAAATAGGTATTGAAATTCTCCTTCCCTCCGTAACCGCCGATGAGGCGGCCTCTCTCTTAGYAACTGTAATA
  F   A   V   F   I   H   N   F   K   R   K   G   G   I   G   G   Y   S   A   G   E   R   I   X   D   I   I>
``` gag 256-285 (18)

```
  7050      7060      7070      7080              7110      7120
   *         *         *         *                 *         *
CGCCASCGATATCRTTCCCGTGGGCGAWATCTATAAGAGATGGATCATTCTGGGACTCAACAAAATCGTGAGAATGTATY
GCGGTSGCTATAGYAAGGGCACCCGCTWTAGATATTCTCTACCTAGTAAGACCCTGAGTTGTTTTAGCACTCTTACATAR
  A   X   D   I   X   P   V   G   X   I   Y   K   R   W   I   I   L   G   L   N   K   I   V   R   M   Y>
``` env 495-524 (169)

```
  7130      7140      7150.     7160      7170               7200
   *         *         *         *         *                  *
MACCCGTCAGCATTCTGGATATCAGAGTGAGACAGGGATACTCCCCCCTCAGCTTTCAGACACTGMYGCCCGCTCCCAGA
KTGGGCAGTCGTAAGACCTATAGTCTCACTCTGTCCCTATGAGGGGGGAGTCGAAAGTCTGTGACKRCGGGCGAGGGTCT
  X   P   V   S   I   L   D   I   R   V   R   Q   G   Y   S   P   L   S   F   Q   T   L   X   P   A   P   R>
```

```
  7210      7220      7230      7240      7250      7260      7270      7280
   *         *         *         *         *         *         *         *
GGCCCTGACAGACYCGRASGCATTGAGGAAGACTCCAGSCAGGACCATCAGTATCCCATTYCCGAACAGCCTCTGYCTCA
CCGGGACTGTCTGRGCYTSCGTAACTCCTTCTCAGGTCSGTCCTGGTAGTCATAGGGTAARGGCTTGTCGGAGACRGAGT
  G   P   D   R   X   X   X   I   E   E   E   S   X   Q   D   H   Q   Y   P   I   X   E   Q   P   L   X   Q>
``` tat 61-90 (122)

```
            7310      7320      7330      7340      7350      7360
             *         *         *         *         *         *
GMCAAGGGGAGRCAATCCCACAGRCCCTRAGGAAAGCAAAAAG[====]GGAGTGGTCGAGTCCATGAATAAGGAACTGA
CKGTTCCCCTCYGTTAGGGTGTCYGGGAYTCCTTTCGTTTTTC[====]CCTCACCAGCTCAGGTACTTATTCCTTGACT
  X   R   G   X   N   P   T   X   P   X   E   S   K   K   A   S   G   V   V   E   S   M   N   K   E   L>
```

B2 join B3 pol 856-885 (91)

```
  7370                7400      7410      7420      7430      7440
   *                   *         *         *         *         *
AAAAGATTATCGGACAGGTCAGGGAMCAGGCTGAGCACCTGAAAACCGCTGTGCAAATGCTGCCATGCAGATGCTCAAG
TTTTCTAATAGCCTGTCCAGTCCCTKGTCCGACTCGTGGACTTTTGGCGACACGTTTACGACGGTACGTCTACGAGTTC
  K   K   I   I   G   Q   V   R   X   Q   A   E   H   L   K   T   A   V   Q   M   A   A   M   Q   M   L   K>
``` gag 196-225 (14)

```
  7450      7460                7490      7500      7510      7520
   *         *                   *         *         *         *
GAWACCATTAACGAAGAGGCTGCCGAGTGGGACAGARTCCATCCCGTCCATGCCGGACCCRTTSCCCCTCTCACCGMGAT
CTWTGGTAATTGCTTCTCCGACGGCTCACCCTGTCTYAGGTAGGGCAGGTACGGCCTGGGYAASGGGGAGAGTGGCKCTA
  X   T   I   N   E   E   A   A   E   W   D   R   K   H   P   V   H   A   G   P   X   X   P   L   T   X   I>
``` pol 181-210 (46)

```
  7530      7540      7550              7580      7590      7600
   *         *         *                 *         *         *
TTGTAMAGAAATGGAAVAAGAAGGCAAAATCTCCARGATTGGCCCTGAGAATCCCTATAACACACCCRTCTTTGCCATTC
AACATKTCTTTACCTTBTTCTTCCGTTTTAGAGGTYCTAACCGGGACTCTTAGGGATATTGTGTGGGYAGAAACGGTAPG
  C   X   E   M   E   X   E   G   K   I   S   X   I   G   P   E   N   P   Y   N   T   P   X   F   A   I>
``` pol 871-900 (92)

```
  7610      7620      7630      7640                7670      7680
   *         *         *         *                   *         *
AAGTGAGAGASCAAGCCGAACACCTCAAGACAGCCGTCCAGATGGCAGTCTTCATTCACAATTTCAAAAGGARAGGCGGA
TTCACTCTCTSGTTCGGCTTGTGGAGTTCTGTCGGCAGGTCTACCGTCAGAAGTAAGTGTTAAAGTTTTCCTYTCCGCCT
  Q   V   R   X   Q   A   E   H   L   K   T   A   V   Q   M   A   V   F   I   H   N   F   K   R   X   G   G>
```

FIGURE 15 (Cont)

```
                                                pol 211-240 (48)
       7690       7700       7710                                  7740       7750       7760
         *          *          *                                     *          *          *
ATCGGAGGCAAAAAGAAAGATAGCACAAAGTGGAGGAAACTGGTAGACTTTAGGGAGCTCAACAAACGTACACAGGATTT
TAGCCTCCGTTTTTCTTTCTATCGTGTTTCACCTCCTTTGACCATCTGAAATCCCTCGAGTTGTTTGCATGTGTCCTAAA
  I  G  G  K  K  K  D  S  T  K  W  R  K  L  V  D  F  R  E  L  N  K  R  T  Q  D  F> env 540-569 (172)
      7770       7780       7790       7800                      7830       7840
        *          *          *          *                         *          *
CTGGGAGGTCCAGCTCGGCTTTTYGGCTCTGGCTTGGGATGACCTCAGGAGCCTGTGTCTGTTCAGCTATCACAGACTGA
GACCCTCCAGGTCGAGCCGAAAARCCGAGACCGAACCCTACTGGAGTCCTCGGACACAGACAAGTCGATAGTGTCTGACT
  W  E  V  Q  L  G  F  X  A  L  A  W  D  D  L  R  S  L  C  L  F  S  Y  H  R  L> vpr 76-96 (117)
      7850       7860       7870       7880       7890                       7920
        *          *          *          *          *                          *
GAGACYTTATCCTCATCGYTGCCAGAAYCTGCCRACATAGCAGAATCGGCATCACTAGGCAACGTAGAGSTAGGAACGGC
CTCTGRAATAGGAGTAGCRACGGTCTTRGACGGYTGTATCGTCTTAGCCGTAGTGATCCGTTGCATCTCSATCCTTGCCG
  R  D  X  I  L  I  X  A  R  X  C  X  H  S  R  I  G  I  T  R  Q  R  R  X  R  N  G> spacers           7950       7960       7970   env 155-184 (147)   8000
                             *          *          *                          *
KCCTCCAGGTCCGCTGCCCCCAAARTCWCCTTCGAMCCCATTCCCATTCACTATTGCGCTCCCGCTGGCTWCGCTATCCT
MGGAGGTCCAGGCGACGGGGGTTTYAGWGGAAGCTKGGGTAAGGGTAAGTGATAACGCGAGGGCGACCGAWGCGATAGGA
  X  S  R  S  A  A  P  K  X  X  F  X  P  I  P  I  H  Y  C  A  P  A  G  X  A  I  L>

8010       8020       8030       8040       8050     vif 76-105 (105)   8080
        *          *          *          *          *                          *
CAAGTGTAACRATAAGAMMTTCAATGGCGAAARGGATTGGCAWCTGGGACASGGAGTGTCCATCGAATGGAGAMWGAAAA
GTTCACATTGYTATTCTKKAAGTTACCGCTTTYCCTAACCGTWGACCCTGTSCCTCACAGGTAGCTTACCTCTKWCTTTT
  K  C  N  X  K  X  F  N  G  E  X  D  W  X  L  G  X  G  V  S  I  E  W  R  X  K>

8090       8100       8110       8120       8130    gag 481-499 (33)    8160
        *          *          *          *          *                           *     ↑
GSTATAGCACACAGGTGGACCCTGRCCTCGCCGATCAGCCTAGGCTCTATCCTCCCTYAGCTTCCCTGAAAAGCCTCTTC  B3
CSATATCGTGTGTCCACCTGGGACYGGAGCGGCTAGTCGGATCCGAGATAGGAGGGARTCGAAGGGACTTTTCGGAGAAG  join
  X  Y  S  T  Q  V  D  P  X  L  A  D  Q  P  S  L  Y  P  P  X  A  S  L  K  S  L  F>   B4
                                                                                       ↓
      8170          spacers       8200       8210    vif 121-150 (108)    8240
        *                           *          *                            *
GGAAACGATCCCTYATCCCAGCCGCTAGAAGGGCTATCCTCGGCCAWAKAGTCAGSAGAAGGTGTGAGTATCMGKCCGG
CCTTTGCTAGGGARTAGGGTCGGCGATCTTCCCGATAGGAGCCGGTWTMTCAGTCSTCTTCCACACTCATAGKCMGGCC
  G  N  D  P  X  S  Q  A  A  R  R  A  I  L  G  X  X  V  X  R  R  C  E  Y  X  X  G>

8250       8260       8270       8280       8290       8300       8310       8320
           *          *          *          *          *          *          *          *
ACACAATAAGGTCGGCTCCCTGCAATACCTCGCACTCAGCCAACCCAMAACCGCTTGCWMCAAGTGTTACTGTAAGAAAT
TGTGTTATTCCAGCCGAGGGACGTTATGGAGCGTGAGTCGGTTGGGTKTTGGCGAACGWKGTTCACAATGACATTCTTTA
  H  N  K  V  G  S  L  Q  Y  L  A  L  S  Q  P  X  T  A  C  X  K  C  Y  C  K  K> tat 16-45 (119)       8350       8360       8370   pol 976-995 (99)    8400
                           *          *          *                          *
GTTGCTWCCACTGTCAGSTCTGCTTCCTGAMGAAGGGACTGGGAATCAGGGATTACGGAAAGCAAATGGCTGGCGMTGAC
CAACGAWGGTGACAGTCSAGACGAAGGACTKCTTCCCTGACCCTTAGTCCCTAATGCCTTTCGTTTACCGACCGCKACTG
  C  C  X  H  C  Q  X  C  F  L  X  K  G  L  G  I  R  D  Y  G  K  Q  M  A  G  X  D> spacers       8440       8450   pol 721-750 (82)    8480
      8410                                 *          *                          *
TGTGTGGCCRGCAGGCAAGACGAAGACGCAGCCAAGTACCATAGCAATTGGAGAACCATGGCCARTGASTTTAACCTCCC
ACACACCGGYCGTCCGTTCTGCTTCTGCGTCGGTTCATGGTATCGTTAACCTCTTGGTACCGGTYACTSAAATTGGAGGG
  C  V  A  X  R  Q  D  E  D  A  A  K  Y  H  S  N  W  R  T  M  A  X  X  F  N  L  P>

8490       8500       8510       8520       8530       8540       8550       8560
           *          *          *          *          *          *          *          *
CCCTATCGTCSCTAAGGAAATCGTCGCAWRTTGCGATAAGTGTAACGAATGGRCACTGGAACTGCTGGAGGAACTGAAAM
GGGATAGCAGSGATTCCTTTAGCAGCGTWYAACGCTATTCACATTGCTTACCYGTGACCTTGACGACCTCCTTGACTTTK
  P  I  V  X  K  E  I  V  A  X  C  D  K  C  N  E  W  X  L  E  L  L  E  E  L  K> vpr 16-45 (113)       8590       8600       8610       8620       8630       8640
                            *          *          *          *          *          *
AWGAAGCCGTGAGACACTTTCCCAGACCCTGGCTGCATGGCCTCGGTCAACAGGATRTCATTAGCCTCTGGGATCAGTCC
TWCTTCGGCACTCTGTGAAAGGGTCTGGGACCGACGTACCGGAGCCAGTTGTCCTAYAGTAATCGGAGACCCTAGTCAGG
  X  E  A  V  R  H  F  P  R  P  W  L  H  G  L  G  Q  H  D  X  I  S  L  W  D  Q  S>
```

```
      8650      env 106-144 (144)    8680         8690         8700         8710         8720
        *                              *            *            *            *            *
CTGAAACCCTGTGTGAAACTGACACCCCTCTGCGTCACCCTCAACTGTACCAATGCCAATCTCMWGAAGAGMTACTCCAC
GACTTTGGGACACACTTTGACTGTGGGGAGACGCAGTGGGAGTTGACATGGTTACGGTTAGACKWCTTCTCKATGAGGTG
   L   K   P   C   V   K   L   T   P   L   C   V   T   L   N   C   T   N  A  N   L   X   K   X   Y   S   T>

8730         8740      vif 91-120 (106)     8770         8780         8790         8800
        *            *                              *            *            *            *
CCAAGTGGACCCCGRTCTGGCTGACCAWCTGATTCACCTCCACTATTTCGATTGCTTTKCCGATAGCRCAATCCATCCCA
GGTTCACCTGGGGCYAGACCGACTGGTWGACTAAGTGGAGGTGATAAAGCTAACGAAAMGGCTATCGYGTTAGGTAGGGT
   Q   V   D   P   X   L   A   D   X   L   I   H   L   H   Y   F   D   C   F   X   D   S   X   I   H   P>

8810         8820         8830   nef 166-195 (190)       8860         8870         8880
        *            *            *                              *            *            *
TSRGCCWACACGGAATGGAGGATGAGGAWAGGGAAGTGCTGAWATGGAAATTCGATAGCCRTCTGGCTCKCAGGCATATS
ASYCGGWTGTGCCTTACCTCCTACTCCTWTCCCTTCACGACTWTACCTTTAAGCTATCGGYAGACCGAGMGTCCGTATAS
   X   X   X   H   G   M   E   D   E   X   R   E   V   L   X   W   K   F   D   S   X   L   A   X   R   H   X>

8890         8900         8910         8920    pol 151-180 (44)        8950         8960              ▲
        *            *            *            *                              *            *                │
GCT░TGTAGT░CCTATCGAWACCGTCCCCGTCAAGCTCAAGCCTGGCATGGACGGACCCAAAGTGAAACAGTGGCCCCTCAC                      B4
CGA░ACATCA░GGATAGCTWTGGCAGGGGCAGTTCGAGTTCGGACCGTACCTGCCTGGGTTTCACTTTGTCACCGGGGAGTG                     join
   A   S   S   P   I   X   T   V   P   V   K   L   K   P   G   M   D   G   P   K   V   K   Q   W   P   L   T>     B5

8970         8980         8990         9000         9010   gag 436-465 (30)          9040              │
        *            *            *            *            *                              *                ▼
CGAAGAGAAAAATCAAAGCCATTTGGCCTAGCMRCAAGGGAAGGCCTGGCAATTTCCYGCAGTCCARGCCTGAGCCTACCG
GCTTCTCTTTTAGTTTCGGTAAACCGGATCGKYGTTCCCTTCCGGACCGTTAAAGGRCGTCAGGTYCGGACTCGGATGGC
   E   E   K   I   K   A   I   W   P   S   X   K   G   R   P   G   N   F   X   Q   S   X   P   E   P   T>

9050         9060         9070         9080         9090    vif 31-60 (102)          9120
        *            *            *            *            *                              *
CACCCCCAGCCGAGARCTTTRGATTCGGCATTAGCAAAAAGGCTAASGGATGGTTTTACAGACACCATTWCGAWAGCCRA
GTGGGGGTCGGCTCTYGAAAYCTAAGCCGTAATCGTTTTTCCGATTSCCTACCAAAATGTCTGTGGTAAWGCTWTCGGYT
   A   P   P   A   E   X   F   X   F   G   I   S   K   K   A   X   G   W   F   Y   R   H   H   X   X   S   X>

9130         9140         9150         9160         9170         9180         9190         9200
        *            *            *            *            *            *            *            *
CACCCTAAGGTCAGCTCCGAGGTCCACATTCCCCTCGGCATGATGACCGCTTGCCAAGGCGTCGGCGGACCCRGTCACAA
GTGGGATTCCAGTCGAGGCTCCAGGTGTAAGGGGAGCCGTACTACTGGCGAACGGTTCCGCAGCCGCCTGGGYCAGTGTT
   H   P   K   V   S   S   E   V   H   I   P   L   G   M   M   T   A   C   Q   G   V   G   G   P   X   H   K> gag 346-375 (24)        9230         9240         9250         9260         9270         9280
                           *            *            *            *            *            *
AGCCAGGGTACTGGCAGAGGCTATGTCCCAGGYGAMCMACGCTAACATTCCTCCCATTGTGSCCAAAGAGATTGTGGCAW
TCGGTCCCATGACCGTCTCCGATACAGGGTCCRCTKGKTGCGATTGTAAGGAGGGTAACACSGGTTTCTCTAACACCGTW
   A   R   V   L   A   E   A   M   S   Q   X   X   X   A   N   I   P   P   I   V   X   K   E   I   V   A>

9290      pol 736-765 (83)       9320         9330         9340         9350         9360
        *                                *            *            *            *            *
RCTGTGACAAATGCCAGCTCAAGGGTGAGGCTATKCACGGACAGGTGRACTGTAGCCCTTCCGAGGGAWCAAGACAGRCT
YGACACTGTTTACGGTCGAGTTCCCACTCCGATAMGTGCCTGTCCACYTGACATCGGGAAGGCTCCCTWGTTCTGTCYGA
   X   C   D   K   C   Q   L   K   G   E   A   X   H   G   Q   V   X   C   S   P   S   E   G   X   R   Q   X>

9370         9380      rev 31-60 (126)         9410         9420         9430         9440
        *            *                                *            *            *            *
AGGARGAACAGACGTAGAAGGTGGCGTGMGAGGCAAAGGCAAATCCRCKCCATCTCCGAGWGGATTCTGGACAGATRAG
TCCTYCTTGTCTGCATCTTCCACCGCACKCTCCGTTTCCGTTTAGGYGMGGTAGAGGCTCWCCTAAGACCTGTCTAYTC
   R   X   N   R   R   R   R   W   R   X   R   Q   R   Q   I   X   X   I   S   E   X   I   L   G   Q   X   R>

9450         9460         9470    gag 226-255 (16)          9500         9510         9520
        *            *            *                                *            *            *
GGAACCCAGAGGCTCCGACATTGCCGGTACCACAAGCACACTGCAAGAGCAAATCGSATGGATGACAACAATCCCCCIR
CCTTGGGTCTCCGAGGCTGTAACGGCCATGGTGTTCGTGTGACGTTCTCGTTTAGCSTACCTACTGTTYGTTAGGGGGAY
   E   P   R   G   S   D   I   A   G   T   T   S   T   L   Q   E   Q   I   X   W   M   T   X   N   P   P>

9530         9540         9550         9560    pol 841-870 (90)         9590         9600
        *            *            *            *                                *            *
RCATTMAGCAAGAGTTTGGCATTCCCTATAACCCTCAGTCCCAGGGCGTCGTGGAAAGCATGAACAAAGAGCTCAAGAAA
YGTAAKTCGTTCTCAAACCGTAAGGGATATTGGGAGTCAGGGTCCRCGCAGCACCTTTCGTACTTGTTTCTCGAGTTCTTT
   X   I   X   Q   E   F   G   I   P   Y   N   P   Q   S   Q   G   V   V   E   S   M   N   K   E   L   K   K>
```

```
                 9610       9620       9630    nef 106-135 (186)  9660       9670       9680
                   *          *          *                          *          *          *
ATCATTGGCAGACAGGAGATCCTCGATCTCTGGGTCTACMATACCCAAGGCTWTTTCCCTGACTGGCASAATTACACACC
TAGTAACCGTCTGTCCTCTAGGAGCTAGAGACCCAGATGKTATGGGTTCCGAWAAAGGGACTGACCGTSTTAATGTGTGG
    I   I   G   R   Q   E   I   L   D   L   W   V   Y   X   T   Q   G   X   F   P   D   W   X   N   Y   T   P>

9690       9700       9710       9720    rev 46-75 (127)      9750       9760
                   *          *          *          *                          *          *                   B5
CGGACCCGGARYCAGATAC GGTACC AGAGMAAGACAGAGACAGATTCRTKCTATTAGCGAAWGGATTCTCAGCAMCTKCC                           join
GCCTGGGCCTYRGTCTATC CCATGG TCTCKTTCTGTCTCTGTCAAGYAHGATAATCGCTTWCCTAAGAGTCGTKGAMGG                            B6
    G   P   G   X   R   Y   P   S   R   X   R   Q   R   Q   I   X   X   I   S   E   X   I   L   S   X   X>

9770       9780       9790       9800       9810   gag 301-330 (21)      9840
                   *          *          *          *          *                          *
TCGGCAGAYCCGCTGAGCCTGTGCCTCTGCAACTG TWTAAGACACTGAGAGCCGAACAGGCTWCCCAAGASGTCAAGAAT
AGCCGTCTRGGCGACTCGGACACGGAGACGTTGAC AWATTCTGTGACTCTCGGCTTGTCCGAWGGGTTCTSCAGTTCTTA
    L   G   R   X   A   E   P   V   P   L   Q   L   X   K   T   L   R   A   E   Q   A   X   Q   X   V   K   N>

9850       9860       9870       9880       9890       9900       9910       9920
                   *          *          *          *          *          *          *          *
TGGATGACCGASACACTGCTCGTGCAAAACGCTAACCCTGACTGT GAGARAGTGTATCTGKCTTGGGTCCCCGCTCATAA
ACCTACTGGCTSTGTGACGAGCACGTTTTGCGATTGGGACTGACA CTCTYTCACATAGACMGAACCCAGGGGCGAGTATT
    W   M   T   X   T   L   L   V   Q   N   A   N   P   D   C   E   X   V   Y   L   X   W   V   P   A   R   K> pol 676-705 (79)        9950       9960       9970       9980       9990      10000
                              *          *          *          *          *          *
AGGCATTGGCCGAAACGAACAGGTGGACAAACTGGTCAKCKCTGGCATTAGGAAA ACAGACCCTAACCCTCAGGAARTCS
TCCGTAACCGCCTTTGCTTGTCCACCTGTTTGACCAGTMGMGACCGTAATCCTTT TGTCTGGGATTGGGAGTCCTTYAGS
    G   I   G   G   N   E   Q   V   D   K   L   V   X   X   G   I   R   K   T   D   P   N   P   Q   E   X>

10010   env 76-105 (142)     10040      10050      10060      10070      10080
                   *                          *          *          *          *          *
WTCTGGAAAACGTCACCGAGAACTTTAACATGTGGAAAAACRATATGGTGGASCAAATGCAWGAC GCTCGCTWTGCCATT
WAGACCTTTTGCAGTGGCTCTTGAAATTGTACACCTTTTTGYTATACCACCTSGTTTACGTWCTC CGACCGAWACGGTAA
    X   L   E   N   V   T   E   N   F   N   M   W   K   N   X   M   V   X   Q   M   X   E   A   G   X   A   I>

10090      10100   env 170-199 (148)    10130      10140      10150      10160
                   *          *                          *          *          *          *
CTGAAATGCAATRACAAAAMSTTCAACGGAACTGGACCCTGTAMGAATGTGTCCASCGTCCAGTGTACCCATGGCCWAGA
GACTTTACGTTAYTGTTTTKSAAGTTGCCTTGACCTGGGACATKCTTACACAGGTSGCAGGTCACATGGGTACCGGWTCT
    L   K   C   N   X   K   K   X   F   N   G   T   G   P   C   X   N   V   S   X   V   Q   C   T   H   G   X   E>

10170      10180      10190   env 600-629 (176)    10220      10230      10240
                   *          *          *                          *          *          *
GCTCAAGAWTAGCGCTRTCTCCCTGCTCAACGCTACCGCTATCGCTGTGGCTGRGKGGACCGATAGGRTTATCGAAGTGG
CGAGTTCTWATCGCGAYAGAGGGACGAGTTGCGATGGCGATAGCGACACCGACYCMCCTGGCTATCCYAATAGCTTCACC
    L   K   X   S   A   X   S   L   L   N   A   T   A   I   A   V   A   X   X   T   D   R   X   I   E   V>

10250      10260      10270      10280   vif 46-75 (103)     10310      10320
                   *          *          *          *                          *          *
YTCAC TCCCRGCATCCCAAAGTGTCCAGCGAAGTGCATATCCCTCTGGGAGASGCTAGGCTCRTCATTARGACATACTGG
RAGTG AGGGYCGTAGGGTTTCACAGGTCGCTTCACGTATAGGGAGACCCTCTSCGATCCGAGYAGTAATYCTGTATGACC
    X   Q   S   X   H   P   K   V   S   S   E   V   H   I   P   L   G   X   A   R   L   X   I   X   T   Y   W>

10330   spacers            10360      10370     nef 1-30 (179)        10400
                   *                          *          *                             *
GGCCTCCASACAGGC GCTGC TATGGGCGGTAAATGGTCCAAGWGCTCCCYCGTCGGATGGCCCGMAGTGAGAGAGAGAAT
CCGGAGGTSTGTCCC CGACGA TACCCGCCATTTACCAGGTTCWCGAGGGRGCAGCCTACCGGGCKTCACTCTCTCTCTTA
    G   L   X   T   G   A   A   M   G   G   K   W   S   K   X   S   X   V   G   W   P   X   V   R   E   R   I>

10410      10420      10430      10440      10450    pol 496-525 (67)     10480
                   *          *          *          *          *                          *
CAGACRGRCASCCCCTGCCGCTGAGGGAGTC CTCAAGACCGGCAAGTACKCTAGGAWGAGGRGTGCCCATACCAATGACG
GTCTGYCYGTSGGGGACGGCGACTCCCTCAC GAGTTCTGGCCGTTCATGMGATCCTWCTCCYCACGGGTATGGTTACTGC
    R   X   X   X   P   A   A   E   G   V   L   K   T   G   K   Y   X   R   X   R   X   A   H   T   N   D>

10490      10500      10510      10520      10530      10540      10550     10560   B6
                   *          *          *          *          *          *          *          *   join
TCARGCAACTGACAGMGGYTGTGCAAAAGATTGCCACAGAC TCTAGA TGGGAGGSTCTGAAATACTKGKGGAATCTGCTC
AGTYCGTTGACTGTCKCCRACACGTTTTCTAACGGTGTCTG AGATCT ACCCTCCSAGACTTTATGAMCMCCTTAGACGAG  B7
    V   X   Q   L   T   X   X   V   Q   K   I   A   T   E   S   S   W   E   X   L   K   Y   X   X   N   L   L>
```

FIGURE 15 (Cont)

env 585-614 (175)      10590      10600      10610      10620      10630      10640

```
CWGTACTGGGGCCWGGAACTGAAAAWCTCCGCCRTCAGCCTCCTGAATGCCACAGCCATTSWGCTGCCTGAGAAAGAWAG
GWCATGACCCCGGWCCTTGACTTTTWGAGGCGGYAGTCGGAGGACTTACGGTGTCGGTAASWCGACGGACTCTTTCTWTC
   X  Y  W  G  X  E  L  K  X  S  A  X  S  L  L  N  A  T  A  I  X  L  P  E  K  X  S>
```

10650   pol 391-420 (60)   10680      10690      10700      10710      10720

```
CTGGACCGTCAACGATATCCAAAAGCTCGTGGGAAAGCTCAACTGGGCATCCCAGATTTACSCCGGAAGAGCCATTGAGG
GACCTGGCAGTTGCTATAGGTTTTCGAGCACCCTTTCGAGTTGACCCGTAGGGTCTAAATGSGGCCTTCTCGGTAACTCC
   W  T  V  N  D  I  Q  K  L  V  G  K  L  N  W  A  S  Q  I  Y  X  G  R  A  I  E>
```

10730      10740   env 345-374 (159)   10770      10780      10790      10800

```
CTCAGCAACACWTGCTGCAACTGACAGTGTGGGGCATTAAGCAACTGCAAGCCAGAGTGCTCGCCRTTGAGAGATACCTC
GAGTCGTTGTGWACGACGTTGACTGTCACACCCCGTAATTCGTTGACGTTCGGTCTCACGAGCGGYAACTCTCTATGGAG
   A  Q  Q  H  X  L  Q  L  T  V  W  G  I  K  Q  L  Q  A  R  V  L  A  X  E  R  Y  L>
```

10810      10820      10830   pol 631-660 (76)   10860      10870      10880

```
GCCCTCCAGGATAGCGGATYGGAAGTGAATATCGTCACCGATAGCCAATACGCTCTAGGCATCATTCWGGCTCAGCCTGA
CGGGAGGTCCTATCGCCTARCCTTCACTTATAGCAGTGGCTATCGYAGATCCGTAGTAAGWCCGAGTCGGACT
   A  L  Q  D  S  G  X  E  V  N  I  V  T  D  S  Q  Y  A  L  G  I  I  X  A  Q  P  D>
```

10890      10900      10910      10920   env 420-449 (164)   10950      10960

```
CARAAGCGAAAGGGAAATCTCCAACTATACCARTCWGATTTACRAGATCCTCACCGAATCTCAAAATCAACAGGATAGGA
GTYTTCGCTTTCCCTTTAGAGGTTGATATGGTYAGWCTAAATGYTCTAGGAGTGGCTTAGAGTTTTAGTTGTCCTATCCT
   X  S  E  R  E  I  S  N  Y  T  X  X  I  Y  X  I  L  T  E  S  Q  N  Q  Q  D  R>
```

10970      10980      10990      11000      11010   env 285-314 (155)   11040

```
ATGAGMAAGASCTCCTGGCTCCCACAARGGCTAAGAGAAGGGTCGTGSAAAGGGAAAAGCGTGCCGTCGGCMTTGGCGCT
TACTCKTTCTSGAGGACCGAGGGTGTTYCCGATTCTCTTCCCAGCACSTTTCCCTTTTCGCACGGCAGCCGKAACCGCGA
   N  E  X  X  L  L  A  P  T  X  A  K  R  R  V  V  X  R  E  K  R  A  V  G  X  G  A>
```

11050      11060      11070      11080      11090   pol 91-120 (40)   11120

```
ATGWTTYTCGGATTCCTCGGCGCTGCCAAACCCAAAATGATCGGAGGCATTGGAGGCTTTATCAAAGTCAGGCAGTATGA
TACWAARAGCCTAAGGAGCCGCGACGGTTTGGGTTTTACTAGCCTCCGTAACCTCCGAAATAGTTTCAGTCCGTCATACT
   M  X  X  G  F  L  G  A  A  K  P  K  M  I  G  G  I  G  G  F  I  K  V  R  Q  Y  D>
```

11130      11140      11150      11160      11170      11180      11190      11200

```
CCAAATCMTTATCGAAATCTGTGGAMASAAGGCTATCTCCTACCATAGGCTCAGGGATTTCATTCTGATCGYCGCTAGGA
GGTTTAGKAATAGCTTTAGACACCTKTSTTCCGATAGAGGATGGTATCCGAGTCCCTAAAGTAAGACTAGCRGCGATCCT
   Q  I  X  I  E  I  C  G  X  K  A  I  S  Y  H  R  L  R  D  F  I  L  I  X  A  R>
``` env 555-584 (173)   11230      11240      11250      11260      11270      11280

```
YTGTGGAACTGCTCGGCCRTAGCCTCCCTGARAGGCCTCCRGAGAGGCACACTGAATGCCTGGGTGAAAGTGRTTGAGGAA
RACACCTTGACGAGCCGGYATCGAGGGACTYTCCGGAGGYCTCTCCGTGACTTACGGACCCACTTTCACYAACTCCTT
   X  V  E  L  L  G  X  S  S  L  X  G  L  X  R  G  T  L  N  A  W  V  K  V  X  E  E>
```

11290   gag 151-180 (11)   11320      11330      11340      11350      11360

```
AAGGSATTCARTCCCGAAGTGATTCCCATGTTTWCCGCTCTGTCCGAGGGAGCCACTGAGTCTAGCAACACASCCGCTAA
TTCCSTAAGTYAGGGCTTCACTAAGGGTACAAAWGGCGAGACAGGCTCCCTCGGTGTGACTCTGTCGTTGTGTSGGCGATT
   K  X  F  X  P  E  V  I  P  M  F  X  A  L  S  E  G  A  T  L  E  S  N  T  X  A  N>
```

B7 join C1

11370      11380   nef 46-75 (182)   11410      11420      11430      11440

```
CAATSCCGATTGCGYGTGGCTGRAAGCCCAGGAAGAGGAAGRAGTGGGATTTCCTGTGAGACCCCAAGTGCCTAGAGCCK
GTTASGGCTAACGCRCACCGACYTTCGGGTCCTTCTCCTTCYTCACCCTAAAGGACACTCTGGGGTTCACGGATCTCGGM
   N  X  D  C  X  W  L  X  Q  E  E  E  X  V  G  F  P  V  R  P  Q  V  P  R  A>
```

11450   env 630-651 (178)   11480      11490      spacers      11520

```
GGAGGGCTATCCTCMACATTCCCASGAGGATTAGGCAAGGCYTTGAGAGAGCCCTCCTAGCCGCCGAATGGGATAGGRTT
CCTCCCGATAGGAGKTGTAAGGGTSCTCCTAATCCGTTCCGRAACTCTCTCGGGAGGATCGGCGGCTTACCCTATCCYAA
   X  R  A  I  L  X  I  P  X  R  I  R  Q  G  X  E  R  A  L  L  A  A  E  W  D  R  X>
```

FIGURE 15 (Cont)

```
        11530        11540    gag 211-240 (15)   11570       11580        11590        11600
           *            *                          *           *            *            *
        CACCCTGTGCACGCTGGCCCTRTCSCTCCCGGCCAAATSAGAGAGCCCAGGGGAAGCGATATCGCTGGCACAACCCTCAG
        GTGGGACACGTGCGACCGGGAYAGSGAGGGCCGGTTTASTCTCTCGGGTCCCCTTCGCTATAGCGACCGTGTTGGGAGTC
         H  P  V  H  A  G  P  X  X  P  G  Q  X  R  E  P  R  G  S  D  I  A  G  T  T  L  R>

11610.       11620        11630  nef 76-105 (184)   11660        11670        11680
             *            *            *                        *            *            *
        GCCCATGACATATAAGGSCGCTRTTGACCTCAGCYTGTTTCTGAAAGAGAAAGGCGGACTGGAWGGCCTCRTCTATAGCM
        CGGGTACTGTATATTCCSGCGAYAACTGGAGTCGRACAAAGACTTTCTCTTTCCGCCTGACCTWCCGGAGYAGATATCGK
         P  M  T  Y  K  X  A  X  D  L  S  L  F  L  K  E  K  G  G  L  X  G  L  X  Y  S> spacers                   11710        11720    vpr 1-30 (112)   11750        11760
                                        *            *                        *            *
        AGAAAGCTGCTATGGAACAGGCTCCCGAAGACCAARGCYCTCAGAGAGAGCCTTACAATGAGTGGRCCCTGGAGCTCCTG
        TCTTTCGACGATACCTTGTCCGAGGGCTTCTGGTTYCGRAGTCTCTCTCGGAATGTTACTCACCYGGGACCTCGAGGAC
         X  K  A  A  M  E  Q  A  P  E  D  Q  X  X  Q  R  E  P  Y  N  E  W  X  L  E  L  L>

11770        11780        11790 · 11800        11810    pol 481-510 (66)   11840
              *            *            *       *            *                          *
        GAAGAGCTCAAGMAMGAGGCTCAAGRCCAATGGACCTWCCAAATCTWTCAGGAACCCTTTAAGAATCTGAAAACCGGAAA
        CTTCTCGAGTTCKTKCTCCGAGTTCYGGTTACCTGGAWGGTTTAGAWAGTCCTTGGGAAATTCTTAGACTTTTGGCCTTT
         E  E  L  K  X  E  A  Q  X  Q  W  T  X  Q  I  X  Q  E  P  F  K  N  L  K  T  G  K>

11850        11860        11870        11880        11890        11900        11910        11920
              *            *            *            *            *            *            *            *
        GTATKCCAGAAWGAGARGCGCTCACACAAACTGGATGACAGAWACCCTCCTGGTCCAGAATGCCAATCCCGATTGCAAGW
        CATAMGGTCTTWCTCTYCGCGAGTGTGTTTGACCTACTGTCTWTGGGAGGACCAGGTCTTACGGTTAGGGCTAACGTTCW
         Y  X  R  X  R  X  A  H  T  N  W  M  T  X  T  L  L  V  Q  N  A  N  P  D .C  K> gag 316-345 (22)       11950        11960        11970        11980        11990        12000
                                  *            *            *            *            *            *
        CCATCCTCARGGCTCTGGGAMCCGGAGCCWCACTGGAAGAGCCTGAGGTCATCCCTATGTTCWCAGCCCTCAGCGAAGGC
        GGTAGGAGTYCCGAGACCCTKGGCCTCGGWGTGACCTTCTCGGACTCCAGTAGGGATACAAGWGTCGGGAGTCGCTTCCG
         X  I  L  X  A  L  G  X  G  A  X  L  E  E  P  E  V  I  P  M  F  X  A  L  S  E  G>

12010   gag 166-195 (12)     12040        12050        12060        12070        12080
              *                            *            *            *            *            *
        GCTACCCCCAAGACCTGAATAYGATGCTCAACAYCGTCGGCGGACACCAATCCACCCTCCAGGAACAGATTGSCTGGAT
        CGATGGGGGGTTCTGGACTTATRCTACGAGTTGTRGCAGCCGCCTGTGGTTAGGTGGGAGGTCCTTGTCTAACSGACCTA
         A  T  P  Q  D  L  N  X  M  L  N  X  V  G  G  H  Q  S  T  L  Q  E  Q  I  X  W  M>

12090        12100    gag 241-270 (17)    12130        12140        12150        12160
              *            *                            *            *            *            *         C1
        GACAARTAACCCTCCCRTCCCTGTCGGAGASATTTACAAAAGGTGGATTATCCTCGGCCTG▒▒▒▒▒ATCCCCCATCCCG   join
        CTGTTYATTGGGAGGGYAGGGACAGCCTCTSTAAATGTTTTCCACCTAATAGGAGCCGGAC▒▒▒▒▒TAGGGGGTAGGGC    C2
         T  X  N  P  P  X  P  V  G  X  I  Y  K  R  W  I  I  L  G  L  T  R  I  P  H  P>

12170        12180        12190    pol 241-270 (50)   12220        12230        12240
              *            *            *                          *            *            *
        CCGGCCTCAAGAAAAAGAAAAGCGTCACCGTCCTGGATGTGGGAGACGCTTACTTCAGCGTCCCCCTCGACRAARRGCAA
        GGCCGGAGTTCTTTTTCTTTTCGCAGTGGCAGGACCTACACCCTCTGCGAATGAAGTCGCAGGGGGAGCTGYTTYYGGTT
         A  G  L  K  K  K  K  S  V  T  V  L  D  V  G  D  A  Y  F  S  V  P  L  D  X  X  Q>

12250        12260        12270        12280    pol 541-570 (70)    12310        12320
              *            *            *            *                            *            *
        ARGGAAACCTGGGAGRCTTGGTGGAYGGAMTACTGGCAGGCTACCTGGATTCCTGAGTGGGAGTTTGTGAATACCCCTCC
        TYCCTTTGGACCCTCYGAACCACCTRCCTKATGACCGTCCGATGGACCTAAGGACTCACCCTCAAACACTTATGGGGAGG
         X  E  T  W  E  X  W  W  X  X  Y  W  Q  A  T  W  I  P  E  W  E  F  V  N  T  P  P>

12330        12340        12350        12360        12370    nef 121-150 (187)    12400
              *            *            *            *            *                            *
        CCTCGTCTTTCCCGATTGGCAWAACTATACCCCTGGCCCTGGCRYAAGGTATCCCCTCACCTTTGGATGGTGCTTTAAGC
        GGAGCAGAAAGGGCTAACCGTWTTGATATGGGGACCGGGACCGYRTTCCATAGGGGAGTGGAAACCTACCACGAAATTCG
         L  V  F  P  D  W  X  N  Y  T  P  G  P  G  X  R  Y  P  L  T  F  G  W  C  F  K>

12410        12420        12430        12440        12450    pol 571-600 (72)   12480
              *            *            *            *            *                          *
        TCGTGCCTGTGGACCCCAAACTGTGGTACCAACTGGAAAAGGAMCCCATTGYCGGAGYCGAAACCTTTTACGTGGACGGA
        AGCACGGACACCTGGGGTTTGACACCATGGTTGACCTTTTCCTKGGGTAACRGCCTCRGCTTTGGAAAATGCACCTGCCT
         L. V  P  V  D  P  K  L  W  Y  Q  L  E  K  X  P  I  X  G  X  E  T  F  Y  V  D  G>
```

FIGURE 15 (Cont)

```
        12490      12500      12510      12520    gag 136-165 (10)   12550      12560
          *          *          *          *                           *          *
GCCGCCARCAGAGAGACAAAGCTCGGCCAAAACSYCCAGGGACAGATGGTGCATCAGSCTMTTAGCCCCAGGACCCTCAA
CGGCGGTYGTCTCTCTGTTTCGAGCCGGTTTTGSRGGTCCCTGTCTACCACGTAGTCSGAKAATCGGGGTCCTGGGAGTT
  A  A  X  R  E  T  K  L  G  Q  N  X  Q  G  Q  M  V  H  Q  X  X  S  P  R  T  L  N>

12570      12580      12590      12600      12610    env 61-90 (141)    12640
          *          *          *          *          *                           *
CGCTTGGGTCAAGGTCRTCGAAGAGAAAGSCTTTARGGAMACCGAAGTGCATAACGTCTGGGCTACCCATGCCTGTGTGC
GCGAACCCAGTTCCAGYAGCTTCTCTTTCSGAAATYCCTKTGGCTTCACGTATTGCAGACCCGATGGGTACGGACACACG
  A  W  V  K  V  X  E  E  K  X  F  X  X  T  E  V  H  N  V  W  A  T  H  A  C  V>

12650      12660      12670      12680      12690      12700      12710      12720
          *          *          *          *          *          *          *          *
CTACCGATCCCAATCCCCAAGAGRTTSWCCTGGAGAATGTGACAGACCTCAAGGATCAGMAAYTCCTCGGCMTTTGGGGA
GATGGCTAGGGTTAGGGGGTTCTCYAASWGGACCTCTTACACTGTCTCGAGTTCCTAGTCKTTRAGGAGCCGKAAACCCCT
  P  T  D  P  N  P  Q  E  X  X  L  E  N  V  T  E  L  K  D  Q  X  X  L  G  X  W  G> env 375-404 (161)    12750      12760      12770      12780      12790      12800
          *                *          *          *          *          *          *
TGCTCCGGCAAAMTCATTTGCACAACCRMTGTGCCTTGGAACAGCWCCTGGTCCAACCMAKCTGGCCATAACAAAGTGGG
ACGAGGCCGTTTKAGTAAACGTGTTGGYKACACGGAACCTTGTCGWGGACCAGGTTGGKTMGACCGGTATTGTTTCACCC
  C  S  G  K  X  I  C  T  T  X  V  P  W  N  S  X  W  S  N  X  X  G  H  N  K  V  G>

12810    vif 136-165 (109)   12840      12850      12860      12870      12880
          *                           *          *          *          *          *
AAGCCTCCAGTATCTGGCTCTGAMGGCTCTGATTAMGCCTAAGAAAATCARACCCCCTCTGCCTAGCGYTAAGACAATCA
TTCGGAGGTCATAGACCGAGACTKCCGAGACTAATKCGGATTCTTTTAGTYTGGGGGAGACGGATCGCRATTCTGTTAGT
  S  L  Q  Y  L  A  L  X  A  L  I  X  P  K  K  I  X  P  P  L  P  S  X  K  T  I>

12890      12900    env 230-254 (152)   12930              spacers        12960   C2
          *          *                           *                                  *    join
TTGTGCATCTGAATAGTCCGTGGWAATCAATTGCACAAGGCCTARCAATAACACAAGGAMAGCCGCGGCTAGTGAAGWA      C3
AACACGTAGACTTAYTCAGGCACCWTTAGTTAACGTGTTCCGGATYGTTATTGTGTTCCTKTCGGCGGGATCACTTCWT
  I  V  H  L  N  X  S  V  X  I  N  C  T  R  P  X  N  N  T  R  X  A  A  A  S  E  X>

12970      12980      12990    gag 106-135 (8)    13020      13030      13040
          *          *          *                           *          *          *
CAGAAWAAGTCCMAACAGAAAAACCCAGCAAGCCGCCGGATACAGGCARCTCCAGCMAGGTCAGCCAAAAACTATCCCAT
GTCTTWTTCAGGKTTGTCTTTTGGGTCGTTCGGCGGCGGCTATGTCCGTYGAGGTCGKTCCAGTCGGTTTTGATAGGGTA
  Q  X  K  S  X  Q  K  T  Q  Q  A  A  A  D  T  G  X  S  S  X  V  S  Q  N  Y  P  I>

13050      13060      13070      13080    pol 826-855 (89)    13110      13120
          *          *          *          *                           *          *
TGTCGTCCAACTTTACCTCCRCCRCTGTGAAAGCCGCTTGTTGGTGGGCCRRTATCMAACAGGAGTTTGGAATCCCTTACA
ACACAGGTTGAAATGGAGGYGGYGACACTTTCGGCGAACAACCACCCGGYYATAGKTTGTCCTCAAACCTTAGGGAATGT
  V  S  N  F  T  S  X  X  V  K  A  A  C  W  W  A  X  I  X  Q  E  F  G  I  P  Y>

13130      13140      13150      13160      13170    pol 586-615 (73)    13200
          *          *          *          *          *                           *
ATCCCCAAAGCCAPACATTCTATGTGGATGGCGCTGCCARTAGGGAAACCAAACTGGGAAAGGCTGGCTATGTGACAGAC
TAGGGGTTTCGGTTTGTAAGATACACCTACCGCGACGGTYATCCCTTTGGTTTGACCCTTTCCGACCGATACACTGTCTG
  N  P  Q  S  Q  T  F  Y  V  D  G  A  A  X  R  E  T  K  L  G  K  A  G  Y  V  T  D>

13210      13220      13230      13240      13250    pol 766-795 (85)    13280
          *          *          *          *          *                           *
AGAGGCAGACAGAAARTCRTTAGCGGAATCTGGCAGCTCGACTGTACCCATCTGGAAGGCAAARTCATTCTGGTAGCCGT
TCTCCGTCTGTCTTTTAGYAATCCCCCTTAGACCGTCGAGCTGACATGGGTAGACCTTCCGTTTYAGTAAGACCATCGGCA
  R  G  R  Q  K  X  X  S  G  I  W  Q  L  D  C  T  H  L  E  G  K  X  I  L  V  A  V>

13290      13300      13310      13320      13330      13340      13350      13360
          *          *          *          *          *          *          *          *
CCACGTCGCCTCCGGCTACATTGAGGCTGAGGTCGGCAATGAGCAAGTGGATAAGCTCGTGAKTKCCGGAATCAGAAAGG
GGTGCAGCGGAGGCCGATGTAACTCCGACTCCAGCCGTTACTCGTTCACCTATTCGAGCACTMAMGGCCTTAGTCTTTCC
  H  V  A  S  G  Y  I  E  A  E  V  G  N  E  Q  V  D  K  L  V  X  X  G  I  R  K> pol 691-720 (80)    13390      13400      13410      13420      13430      13440
                          *          *          *          *          *          *
TGCTATTCCTCGACGGAATCRATAAGGCTCAGGAAGAGCACGAAGTCAGGGAAAGGATTAGGCRARCCSCTCCCGCTGCT
ACGATAAGGAGCTGCCTTAGYTATTCCGAGTCCTTCTCGTGCTTCAGTCCCTTTCCTAATCCGYTYGGSGAGGGCGACGA
  V  L  F  L  D  G  I  X  K  A  Q  E  E  H  E  V  R  E  R  I  R  X  X  X  P  A  A>
```

FIGURE 15 (Cont)

```
         nef 16-45 (180)    13470      13480      13490      13500      13510      13520
                              *          *          *          *          *          *
GAAGGCGTCGGCGCTGYCTCCCRGGATCTGGATAAGKACGGAGCCMTCACCTC|ACAAGCGGAACCCAACAGTCCCAGGG
CTTCCGCAGCCGCGACRGAGGGYCCTAGACCTATTCMTGCCTCGGKAGTGGAG|TGTTCGCCTTGGGTTGTCAGGGTCCC
  E  G  V ·G  A  X  S  X  D  L  D  K  X  G  A  X  T  S  T  S  G  T  Q  Q  S  Q  G>

13530       rev 91-120 (130)    13560      13570      13580      13590      13600
         *           *                   *          *          *          *          *
AACTGAAACTGGCGTCGGCMRCCCTCAGATTTYGGGAGAGTCCAGCGYTRTCCTCGGCYCCGG|TCCATCGTCATCTGGG
TTGACTTTGACCGCAGCCGKYGGGAGTCTAAARCCCTCTCAGGTCGCRAYAGGAGCCGRGGCC|AGGTAGCAGTAGACCC
  T  E  T  G  V  G  X  P  Q  I  X  G  E  S  S  X  X  L  G  X  G  S  I  V  I  W>

13610      13620     pol 526-555 (69)    13650      13660         spacers
           *          *                             *          *              ┌──►
GTAAAACCCCTAAGTTTARGCTCCCCATTCAGARAGAGACATGGGAARCCTGGTGGAYGGASTATTGGCAAGCC|GCTGCT
CATTTTGGGGATTCAAATYCGAGGGGTAAGTCTYTCTCTGTACCCTTGGACCACCTRCCTSATAACCGTTCGG|CGACGA
  G  K  T  P  K  F  X  L  P  I  Q  X  E  T  W  E  X  W  W  X  X  Y  W  Q  A  A  A>

13690      13700      13710     env 140-169 (146)   13740      13750      13760
           *          *          *                             *          *          *
TACAGACTGATCARCTGTAACACAAGCGYTATCAMACAGGCTTGCCCTAAGRTTASCTTTGASCCTATCCCTATCCATTA
ATGTCTGACTAGTYGACATTGTGTTCGCRATAGTKTGTCCGAACGGGATTCYAATSGAAACTGGGATAGGGATAGGTAAT
  Y  R  L  I  X  C  N  T  S  X  I  X  Q  A  C  P  K  X  X  F  X  P  I  P  I  H  Y>
                                                                                       ▲
         13770      13780      13790      13800     pol 376-405 (59)    13830      13840  │
           *          *          *          *                             *          *    │
CTGTGCCCC▓▓▓▓▓▓▓TGGATGGGCTATGAGCTCCACCCTGACAGATGGACAGTGCAACCCATCSWGCTCCCCGAAAAGG      C3
GACACGGGG▓▓▓▓▓▓▓ACCTACCCGATACTCGAGGTGGGACTGTCTACCTGTCACGTTGGGTAGSWCGAGGGGCTTTTCC   join
  C  A  P  P  S  W  M  G  Y  E  L  H  P  D  R  W  T  V  Q  P  I  X  L  P  E  K>       C4
                                                                                       │
         13850      13860      13870      13880      13890     gag 331-360 (23)   13920  ▼
           *          *          *          *          *                             *
ASTCCTGGACAGTGAATGACATTCA|AAAWCAATTCTGARAGCCCTCGGCMCAGGCGCTWCCCTGGAGGAAATGATGACA
TSAGGACCTGTCACTTACTGTAAGT|TTTWGTTAAGACTYTCGGGAGCCGKGTCCGCGAWGGGACCTCCTTTACTACTGT
  X  S  W  T  V  N  D  I  Q  K  X  I  L  X  A  L  G  X  G  A  X  L  E  E  M  M  T>

13930      13940      13950      13960      13970      13980      13990      14000
           *          *          *          *·         *          *          *          *
GCATGTCAGGGAGTGGGAGGCCCTRGCCATAAGGC|AGAGTGTATTACAGAGACTCCAGGGACCCCMTTTGGAAAGGCCC
CGTACAGTCCCTCACCCTCCGGGAYCGGTATTCCG|TCTCACATAATGTCTCTGAGGTCCCTGGGGKAAACCTTTCCGGG
  A  C  Q  G  V  G  G  P  X  H  K  A  R  V  Y  Y  R  D  S  R  D  P  X  W  K  G  P> pol 931-960 (96)    14030      14040      14050      14060      14070      14080
       *                  *          *          *          *          *          *
TGCCAAACTGCTCTGGAAAGGCGAAGGCGCTGTGGTCATCCAAGA|RTTAAGATTGGAGGCCAACTGAWAGAAGCCCTCC
ACGGTTTGACGAGACCTTTCCGCTTCCGCGACACCAGTAGGTTCT|YAATTCTAACCTCCGGTTGACTWTCTTCGGGAGG
  A  K  L  L  W  K  G  E  G  A  V  V  I  Q  D  X  K  I  G  G  Q  L  X  E  A  L>

14090     pol 61-90 (38)    14120      14130      14140      14150      14160
      *         *                 *          *          *          *          *
TGGATACAGGAGCCGATGACACCGTCCTGGAAGAWATSAATCTGCCTGGCARGTG|GGAATCAAACAGCTCCAGGCTAGG
ACCTATGTCCTCGGCTACTGTGGCAGGACCTTCTWTASTTAGACGGACCGTYCAC|CCTTAGTTTGTCGAGGTCCGATCC
  L  D  T  G  A  D  D  T  V  L  E  X  X  N  L  P  G  X  W  G  I  K  Q  L  Q  A  R>

14170      14180     env 360-389 (160)   14210      14220         spacers
         *          *                             *          *              ┌──►
GTCCTGGCTRTCGAGAGGTATCTGAAAGATCAAAMAGYTTCTGGGAMTCTGGGGCTGTAGCGGAAAC|GCTGCT|ATGGAAAA
CAGGACCGAYAGCTCTCCATAGACTTTCTAGTTKTCRAAGACCCTKAGACCCCGACATCGCCTTTC|CGACGA|TACCTTTT
  V  L  A  X  E  R  Y  L  K  D  Q  X  X  L  G  X  W  G  C  S  G  K  A  A  M  E  N>

14250      14260      14270     vif 1-30 (100)    14300      14310      14320
           *          *          *                           *          *          *
CAGATGGCAAGTGMTGATCGTCTGGCAAGTGGACAGGATGARGATTAGGACATGGAAWAGCCTCGTGAAACACCATATGY
GTCTACCGTTCACKACTAGCAGACCGTTCACCTGTCCTACTYCTAATCCTGTACCTTWTCGGAGCACTTTGTGGTATACR
  R  W  Q  V  X  I  V  W  Q  V  D  R  M  X  I  R  T  W  X  S  L  V  K  H  H  M>

14330      14340      14350      14360     env 390-419 (162)   14390      14400
           *          *          *          *                             *          *
AT|MTTATCTGTACCACARMCGTCCCCTGGAACTCCASCTGGAGCAATAAGTCCYTCGAAGAGATTTGGRATAACATGACC
TR|KAATAGACATGGTGTYKGCAGGGGACCTTGAGGTSGACCTCGTTATTCAGGRAGCTTCTCTAAACCYTATTGTACTGG
  X  X  I  C  T  T  X  V  P  W  N  S  X  W  S  N  K  S  X  E  E  I  W  X  N  M  T>
```

FIGURE 15 (Cont)

```
            14410     14420     14430   vpu 16-45 (133)    14460     14470     14480
               *         *         *                          *         *         *
       TGGATKSAATGCCTGATTMTCGCTATCGTCGTGTGGACCATTGYGTWTATCGAATACARGAAACTGCTCARGCAAAGGAR
       ACCTAMSTTACGGACTAAKAGCGATAGCAGCACACCTGGTAACRCAWATAGCTTATGTYCTTTGACGAGTYCGTTTCCTY
           W  X  X  W  L  I  X  A  I  V  V  W  T  I  X  X  I  E  Y  X  K  L  L  X  Q  R  X>

14490     14500     14510     14520   gag 46-75 (4)     14550     14560
               *         *         *         *                         *         *
       AATCGATAGGCTCATCRAAAGGCTCAACCCTGGCCTCCTGGAAACCKCTGAGGGATGTMAACAGATCCTGGRACAGCTCC
       TTAGCTATCCGAGTAGYTTTCGGAGTTGGGACCGGAGGACCTTTGGMGACTCCCTACAKTTGTCTAGGACCYTGTCGAGG
           I  D  R  L  I  X  R  L  N  P  G  L  L  E  T  X  E  G  C  X  Q  I  L  X  Q  L>        ↑

14570     14580     14590     14600     14610     14620     14630     14640        │
               *         *         *         *         *         *         *         *         C4
       AGYCCGCCCTCMAGACAGGCWCCGAAGAGCTQ▓▓▓▓▓▓AGAAAGCTCCTGARACAGAGAAGGATTGACAGACTGATTRAG         join
       TCRGGCGGGAGKTCTGTCCGWGGCTTCTCGA▓▓▓▓▓▓TCTTTCGAGGACTYTGTCTCTTYCTAACTGTCTGACTAAYTC         C5
           Q  X  A  L  X  T  G  K  E  E  L  S  S  R  K  L  L  X  Q  R  X  I  D  R  L  I  X> vpu 31-60 (134)     14670     14680     14690     14700     14710     14720
                             *         *         *         *         *         *
       AGAAYCAGAGAGAGAGCCGAAGACTCCGGCAATGAGTCCGAGGGAGACACACCCGGAATCAGATACCAATACAATGTGCT
       TCTTRGTCTCTCTCTCGGCTTCTGAGGCCGTTACTCAGGCTCCCTCTGTGGGCCTTAGTCTATGGTTATGTTACACGA
           R  X  R  E  R  A  E  D  S  G  N  E  S  E  G  D  T  P  G  I  R  Y  Q  N  V  L>

14730   pol 286-315 (53)    14760     14770     14780     14790     14800
               *                          *         *         *         *         *
       CCCCCAAGGCTGGAAGGGCTCCCCASCCATTTTCCAAAGCTCCATGMCCMAAATCCTCATGATGCAAAGGGGAAACTTTA
       GGGGGTTCCGACCTTCCCGAGGGGTSGGTAAAAGGTTTCGAGGTACKGGKTTTAGGACTACTACGTTTCCCCTTTGAAAT
           P  Q  G  W  K  G  S  P  X  I  F  Q  S  S  M  X  X  I  L  M  M  Q  R  G  N  F>

14810     14820     14830     14840   gag 376-405 (26)    14850     14870     14880
               *         *         *         *                          *         *         *
       RGGGACMGAAAAGGATTRTCAAGTGCTTCAACTGTGGAAAGGAAGGCCATMTCGCTARGAATTGCAGACCTCCCCTGGAG
       YCCCTGKCTTTTCCTAAYAGTTCACGAAGTTGACACCTTTCCTTCCGGTAKAGCGATYCTTAACGTCTGGAGGGGACCTC
           X  G  X  K  R  I  X  K  C  F  N  C  G  K  E  G  H  X  A  X  N  C  R  P  P  L  E>

14890     14900     14910   rev 76-105 (129)    14940     14950     14960
               *         *         *                          *         *         *
       AGACTGMACCTGGATTGCTCCGAGGATWGCGRCACCTCCGGCACACAGCAAAGCCAAGGCACAGAGACAGGCAGTGGGACT
       TCTGACKTGGACCCTAACGAGGCTCCTAWCGCYGTGGAGGCCGTGTGTCGTTTCGGTTCCGTGTCTCTGTCCTCACCCTGA
           R  L  X  L  D  C  S  E  D  X  X  T  S  G  T  Q  Q  S  Q  G  T  E  T  G  V  G  L>

14970     14980     14990     15000   pol 781-810 (86)    15030     15040
               *         *         *         *                          *         *
       CGTGGCTGTGCATGTGGCCAGCGGATATATCGAAGCCGAAGTGATCCCTGCCGAAACTGGACAGGAAACCGCTTACTTTM
       GCACCGACACGTACACCGGTCGCCTATATAGCTTCGGCTTCACTAGGGACGGCTTTGACCTGTCCTTTGGCGAATGAAAK
           V  A  V  H  V  A  S  G  Y  I  E  A  E  V  I  P  A  E  T  G  Q  E  T  A  Y  F>

15050     15060     15070     15080     15090   env 200-229 (150)    15120
               *         *         *         *         *                          *
       TCCTCAAGATTARGCCTGTGGTCAGCACACAGCTCCTGCTCAACGGTAGCCTCGCTGAAGAGGAARTCRTTATCAGAAGC
       AGGAGTTCTAATYCGGACACCAGTCGTGTGTCGAGGACGAGTTGCCATCGGAGCGACTTCTCCTTYAGYAATAGTCTTCG
           X  L  K  I  X  P  V  V  S  T  Q  L  L  L  N  G  S  L  A  E  E  E  X  X  I  R  S>

15130     15140     15150     15160     15170   pol 406-435 (61)    15200
               *         *         *         *         *                          *
       GAAAACYTTACCRATAACAAACTGGTCGGCAAACTGAATTGGGCTTCCCAAATCTACSCTGGCATCAAAGTGARGCAACT
       CTTTTGRAATGGYTATTGTTTGACCAGCCGTTTGACTTAACCCGAAGGGTTTAGATGSGACCGTAGTTTCACTYCGTTGA
           E  N  X  T  X  N  K  L  V  G  K  L  N  W  A  S  Q  I  Y  X  G  I  K  V  X  Q  L>

15210     15220     15230     15240     15250   env 121-139 (145)    15280
               *         *         *         *         *                          *
       GTGTAAGCTCCTGAGAGGCRCCCAAAGCCCTCACCCCTCTGTGTGACACTGAATTGCACAAACGCTAACCTCATCAATG
       CACATTCGAGGACTCTCCGYGGGTTTCGGGAGTGGGAGACACACACTGTGACTTAACGTGTTTGCGATTGGAGTAGTTAC
           C  K  L  L  R  G  X  K  A  L  T  P  L  C  V  T  L  N  C  T  N  A  N  L  I  N> spacers             15310     15320     15330   tat 76-102 (123)    15360
                             *         *         *                          *
       TGAATGCTGCTCAAMCCAGAGGCGATAACCCTACCGRTCCCRAAGAGTCCAAGAAAAGGTCGMGTCCAAGRCAGAGACA
       ACTTACGACGAGTTKGGTCTCCGCTATTGGGATGGCYAGGGYTTCTCAGGTTCTTTYTCCAGCKCAGGTTCYGTCTCTGT
           V  N  A  A  Q  X  R  G  D  N  P  T  X  P  X  E  S  K  K  X  V  X  S  K  X  E  T>
```

FIGURE 15 (Cont)

```
         spacers        15390         15400       rev 61-90 (128)      15430         15440
GACCCTTKTGACGCCGCGGTACCTCCAMCTKTCTGGGAAGGYCTGCCGAACCCGTCCCCCTCCAGCTCCCCCCTCTGGA
CTGGGAAMACTGCGGCGCGGATGGAGGTKGAMAGACCCTTCCRGACGGCTTGGGCAGGGGGAGGTCGAGGGGGGAGACCT         C5
  D  P  X  D  A  A  P  S  S  X  X  L  G  R  X  A  E  P  V  P  L  Q  L  P  P  L  E>       join
                                                                                           C6

15450    15460        15470        15480        15490        15500        15510        15520
AAGGCTCMACCTCGACTGTAGCGAAGACWGTGRGGMACTGGATAAGTGGGCCTCCCTGTGGAACTGGTTCRATATCWCCA
TTCCGAGKTGGAGCTGACATCGCTTCTGWCACYGCKTGACCTATTCACCCGGAGGGACACCTTGACCAAGYTATAGWGGT
  R  L  X  L  D  C  S  E  D  X  X  X  L  D  K  W  A  S  L  W  N  W  F  X  I  X> env 450-479 (166)   15550       15560       15570       15580       15590       15600
ASTGGCTGTGGTACATTAAGATTTTCATTATGATTGTGGGAGGCAATAAGATTGTCAGGATGTACYMACCTGTCTCCATC
TSACCGACACCATGTAATTCTAAAAGTAATACTAACACCCTCCGTTATTCTAACAGTCCTACATGRKTGGACAGAGGTAG
  X  W  L  W  Y  I  K  I  F  I  M  I  V  G  N  K  I  V  R  M  Y  X  P  V  S  I>

15610          gag 271-300 (19)    15640       15650       15660       15670       15680
CTCGACATTARGCAAGGCCCTAAGGAACCCTTCAGGGATTACGTGGACAGATTCGCTAAGCTCCTGTGGAAGGGAGAGGG
GAGCTGTAATYCGTTCCGGGATTCCTTGGGAAGTCCCTAATGCACCTGTCTAACGATTCGAGGACACCTTCCCTCTCCC
  L  D  I  X  Q  G  P  K  E  P  F  R  D  Y  V  D  R  F  A  K  L  L  W  K  G  E  G>

15690       15700    pol 946-975 (97)    15730       15740       15750       15760
AGCCGTCGTGATTCAGGACAACTCCGACATTAAGGTCGTGCCCAGGAGAAAGGCTAAGATTATCGAACTGAATAAGAGAA
TCGGCAGCACTAAGTCCTGTTGAGGCTGTAATTCCAGCACGGGTCCTCTTTCCGATTCTAATAGCTTGACTTATTCTCTT
  A  V  V  I  Q  D  N  S  D  I  K  V  V  P  R  R  K  A  K  I  I  E  L  N  K  R>

15770       15780       15790      pol 226-255 (49)       15820                spacers
CCCAAGACTTTTGGGAAGTGCAACTGGGAATCCCTCACCCTGCTGGACTGAAAAAGAAAAAGTCCGTGACAGTGGCCGCT
GGGTTCTGAAAACCCTTCACGTTGACCCTTAGGGAGTGGGACGACCTGACTTTTTCTTTTTCAGGCACTGTCACCGGCGA
  T  Q  D  F  W  E  V  Q  L  G  I  P  H  P  A  G  L  K  K  K  K  S  V  T  V  A  A>

15850       15860       15870       15880   env 1-30 (137)      15910       15920
ATGAGAGTGAAAGAGACACAGATGAACTGGCCCAATCTGTGGARGTGGGGCACAMTGATTCTGGGAMTGGTCATSATTTG
TACTCTCACTTTCTCTGTGTCTACTTGACCGGGTTAGACACCTYCACCCCGTGTKACTAAGACCCTKACCAGTASTAAAC
  M  R  V  K  E  T  Q  M  N  W  P  N  L  W  X  W  G  T  X  I  L  G  X  V  X  I  C>

15930       15940       15950       15960       15970   pol 421-450 (62)      16000
CTCCGCCTCGATTAAGGTCARACAGCTCTGCAAACTGCTCAGGGGTRCAAAGGCTCTGACAGASATTGTGMCACTGACAG
GAGGCGGAGCTAATTCCAGTYTGTCGAGACGTTTGACGAGTCCCCAYGTTTCCGAGACTGTCTSTAACACKGTGACTGTC
  S  A  S  I  K  V  X  Q  L  C  K  L  L  R  G  X  K  A  L  T  X  I  V  X  L  T>

16010       16020       16030       16040       16050    nef 181-196 (191)    16080
AGGAAGCCGAACTGGAACTCCTCAWATGGAAGTTTGACTCCCRCCTCGCCCKGAGACATATSGCCAGGGAACTGCRTCCC
TCCTTCGGCTTGACCTTGACGAGTWTACCTTCAAACTGAGGGYGGAGCGGGMCTCTGTATASCGGTCCCTTGACGYAGGG
  E  E  A  E  L  E  L  L  X  W  K  F  D  S  X  L  A  X  R  H  X  A  R  E  L  X  P>

16090       spacers      16120       16130     env 570-599 (174)      16160
GAGTWCTACAAAGACTGCGCTGCTGTCGAGCTCCTGGGACRCTCCAGCCTCARGGGACTGCRAAGGGGATGGGAAGSCCT
CTCAWGATGTTTCTGACCCGACGACAGCTCGAGGACCCTGYGAGGTCGGAGTYCCCTGACGYTTCCCCTACCCTTCSGGA
  E  X  Y  K  D  C  A  A  V  E  L  L  G  X  S  S  L  X  G  L  X  R  G  W  E  X  L>

16170       16180       16190       16200       16210       16220       16230       16240
CAAGTATTKGKGGAACCTCCTGCWGTATTGGGGCTCGAGCTGGRGCAACTGCAAYCTGCTCTGMAAACCGGAWCAGAGG       C6
GTTCATAAMCMCCTTGGAGGACGWCATAACCCCGAGCTCGACCYCGTTGACGTTRGACGAGACKTTTGGCCTWGTCTCC       join
  K  Y  X  X  N  L  L  X  Y  W  G  S  S  L  X  Q  L  Q  X  A  L  X  T  G  X  E>          C7 gag 61-90 (5)        16270       16280       16290       16300       16310       16320
AACTGARGTCCCTGTWTAACACARTCGCTACCCTCTGGTGTGTGCATCAGGAGCTCTACAAATACAAAGTGGTCRAAATC
TTGACTYCAGGGACAWATTGTGTYAGCGATGGGAGACCACACACGTAGTCCTCGAGATGTTTATGTTTCACCAGYTTTAG
  E  L  X  S  L  X  N  T  X  A  T  L  W  C  V  H  Q  E  L  Y  K  Y  K  V  V  X  I>
```

FIGURE 15 (Cont)

```
                16330    env 270-299 (154)    16360        16370        16380        16390        16400
                   *                             *            *            *            *            *
RAACCCCTCGGCRTTGCCCCTACCARAGCCAAAAGGAGAGTGGTCSAGAGAGAGAAAAGCCTCACCGAWATCGTCMCACT
YTTGGGGAGCCGYAACGGGGATGGTYTCGGTTTTCCTCTCACCAGSTCTCTCTTTTCCGAGTGGCTWTAGCAGKGTGA
  X   P   L   G   X   A   P   T   X   A   K   R   R   V   V   X   R   E   K   R   L   T   X   I   V   X   L>

16410        16420    po! 436-465 (63)        16450        16460        16470        16480
           *            *                                *            *            *            *
CACCGAAGAGGCTGAGCTGGAGCTGGMGGAAAACAGAGAGATTCTGARGGAACCCGTCCACGGAGTGTATAGAGTGCTCG
GTGGCTTCTCCGACTCGACCTCGACCKCCTTTTGTCTCTCTAAGACTYCCTTGGGCAGGTGCCTCACATATCTCACGAGC
  T   E   E   A   E   L   E   L   X   E   N   R   E   I   L   X   E   P   V   H   G   V   Y   R   V   L>

16490        16500        16510    gag 361-390 (25)    16540        16550        16560
           *            *            *                            *            *            *
CCGAAGCCATGAGCCAAGYCAMCMATGCCAACATCATGATGCAGAGAGGCAATTTCARAGGCCAAAGAGAATCRTCAAA
GGCTTCGGTACTCGGTTCRGTKGKTACGGTTGTAGTACTACGTCTCTCCGTTAAAGTYTCCGGKTTTCTCTTAGYAGTTT
  A   E   A   M   S   Q   X   X   X   A   N   I   M   M   Q   R   G   N   F   X   G   X   K   R   I   X   K>

16570        16580        16590        16600    nef 61-90 (183)    16630        16640
           *            *            *            *                            *            *
CAAGAGGAAGAGGRGGTCGGCTTCCCCGTCAGGCCTCAGGTCCCACTGAGACCTATGACCTACAAAGSAGCCRTCGATCT
GTTCTCCTTCTCCYCCAGCCGAAGGGGCAGTCCGGAGTCCAGGGTGACTCTGGATACTGGATGTTTCSTCGGYAGCTAGA
  Q   E   E   E   X   V   G   F   P   V   R   P   Q   V   P   L   R   P   M   T   Y   K   X   A   X   D   L>

16650        16660        16670        16680        16690    gag 286-315 (20)    16720
           *            *            *            *            *                            *
GTCCYTCTTCARACAGGGACCCAAAGAGCCTTTCAGAGACTATGTGGATAGGTTTTWCAAAACCCTCAGGGCTGAGCAAG
CAGGRAGAAGTYTGTCCCTGGGTTTCTCGGAAAGTCTCTGATACACCTATCCAAAAWGTTTTGGGAGTCCCGACTCGTTC
  S   X   F   X   Q   G   P   K   E   P   F   R   D   Y   V   D   R   F   X   K   T   L   R   A   E   Q>

16730        16740        16750        16760        16770    gag 16-45 (2)    16800
           *            *            *            *            *                          *
CCWCACAGGAWGTGAAAAACTGGGAGAAAATCAGACTGAGACCTGGTGGCAAAAAGAAATACARAMTGAAACACMTTGTG
GGWGTGTCCTWCACTTTTTGACCCTCTTTTAGTCTGACTCTGGACCACCGTTTTTCTTTATGTYTKACTTTGTGKAACAC
  A   X   Q   X   V   K   N   W   E   K   I   R   L   R   P   G   G   K   K   K   Y   X   X   K   H   X   V>

16810        16820        16830        16840        16850    pol 646-675 (77)    16880
           *            *            *            *            *                            *
TGGGCCTCCAGGGAACTGGAAAGGTTTGCCTCCCAGTATGCCCTCGGCATCATCCWAGCCCAACCCGATARGTCCGAGTC
ACCCGGAGGTCCCTTGACCTTTCCAAACGGAGGGTCATACGGGAGCCGTAGTAGGWTCGGGTTGGGCTATYCAGGCTCAG
  W   A   S   R   E   L   E   R   F   A   S   Q   Y   A   L   G   I   I   X   A   Q   P   D   X   S   E   S>

16890        16900        16910        16920        16930        16940        16950        16960
           *            *            *            *            *            *            *            *
CGAGSTCGTGARTCAGATTATCGAAVAGCTCATCAAGAACATTGCCGTCGCCGRAKGGACAGACAGARTCATTGAGGTCG
GCTCSAGCACTYAGTCTAATAGCTTBTCGAGTAGTTCTTCTAACGGCAGCGGCYTMCCTGTCTGTCTYAGTAACTCCAGC
  E   X   V   X   Q   I   I   E   X   L   I   K   K   I   A   V   A   X   X   T   D   R   X   I   E   V> env 615-644 (177)    16990        17000        17010        17020        17030        17040
                          *            *            *            *            *            *
YCCAAAGGGCTKGGAGAGCCATTCTGMATATCCCCASGAGAATCAGACAGACTACTCGCCGGAAGGTGGCCCGTCARG
RGGTTTCCCGAMCCTCTCGGTAAGACKTATAGGGGTSCTCTTAGTCTGTCTGATCGGAGCGGCCTTCCACCGGGCAGTYC
  X   Q   R   A   X   R   A   I   L   X   I   P   X   R   I   R   Q   T   R   L   A   G   R   W   P   V   X>

17050    pol 811-840 (88)    17080        17090        17100        17110        17120
           *                            *            *            *            *            *
RYAATCCATACCGATAACGGAAGCAATTTCACAAGCRCTRCCGTCAAGGCTGCCTGCTGGTGGGCTGATGTGARACAGCT
YRTTAGGTATGGCTATTGCCTTCGTTAAAGTGTTCGYGAYGGCAGTTCCGACGGACGACCACCCGACTACACTYTGTCGA
  X   I   H   T   D   N   G   S   N   F   T   S   X   X   V   K   A   A   C   W   W   A   D   V   X   Q   L>

17130        17140    pol 511-540 (68)        17170        17180        17190    spacers
           *            *                                *            *            *
CACCGMAGYCGTCCAGAAARTCGCTACCGAAAGCATTGTGATATGGGAAAGACACCCAAGTTCARACTGCCTATCGCTG
GTGGCKTCRGCAGGTCTTTYAGCGATGGCTTTCGTAACACTATACCCCTTTCTGTGGGTTCAAGTYTGACGGATACGAC
  T   X   X   V   Q   K   X   A   T   E   S   I   V   I   W   G   T   P   K   F   X   L   P   I   A>
``` spacers    BglII    EcoRI
```
CCGCCAGCAACGAGAACATGGASRCCATCGCTGCTTGAAGATCTGAATTCGCC
GGCGGTCGTTGCTCTTGTACCTSYGGTACGCGACGAACTTCTAGACTTAACGG
  A   A   S   N   E   N   M   X   X   M   A   A   R   S   E   F   A>
```

Flu NP epi (Mouse)    Stop

C7 join C8

FIGURE 15 (Cont)

```
         10        20        30        40        50        60        70        80
          *         *         *         *         *         *         *         *
CCGCCTAGGTGGTACTGTCCGGGAACGTKTTTGCAGTCGWGGCACGTTACGTGTGTGCCTTAGTYTGGGCAGCACAGGTG
 G  G  S  T  M  T  G  P  C  X  N  V  S  X  V  Q  C  T  H  G  I  X  P  V  V  S  T>

90       100       110       120       130       140       150       160
          *         *         *         *         *         *         *         *
                             TCCCTGARAAGCCTCTWCAATACCRTCGCCACACTGTGGTGCGTCCACCAAAGGATTGASG
 Q  L  L  N  G  S  L  X  S  L  X  N  T  X  A  T  L  W  C  V  H  Q  R  I  X>

170       180       190       200       210       220       230       240
          *         *         *         *         *         *         *         *
TCARGGACACAAAGGAAGCCCTCGACAAAATCGAACTCGGCGATGGCGGAGGCGCTGAWAGGCAAGGCACCTCCAGCTCC

V  X  D  T  K  E  A  L  D  K  I  E  L  G  D  G  G  A  X  R  Q  G  T  S  S  S>

250       260       270       280       290       300       310       320
          *         *         *         *         *         *         *         *
YTCARCTTTCCACAAATCACACTGTGGCAAAGGCCTCTGGTCACCGAACCCTTCAGAAWAMAGAATCCCGAWATGGTGAT

X  X  F  P  Q  I  T  L  W  Q  R  P  L  V  T  E  P  F  R  X  X  N  P  X  M  V  I>

330       340       350       360       370       380       390       400
          *         *         *         *         *         *         *         *
TTACCAGTACATGGACGATCTGTATGTGGGAAGCGATCTGGAAATCGGACAGCATTTTACCACACCCGATAAGAAACACC

Y  Q  Y  M  D  D  L  Y  V  G  S  D  L  E  I  G  Q  H  F  T  T  P  D  K  K  H>

410       420       430       440       450       460       470       480
          *         *         *         *         *         *         *         *
AAAAGGA                                    CCTATGCTTGACGTAGGGCTATCCACCTGGCAGGTCGGARAATYAAAGGGAGTC
 Q  K  E  P  P  F  L  W  M  G  Y  E  L  H  P  D  R  W  T  V  Q  P  X  X  F  P  Q>

490       500       510       520       530       540       550       560
          *         *         *         *         *         *         *         *
TAATGGGAGACCGTCGCAGGGGAGCACTGTYAGTTTTAGCCGCCTGTCGAGTWTCTCCGAGACGAGCTGTGTCCGAGGRT
 I  T  L  W  Q  R  P  L  V  T  X  K  I  G  G  Q  L  X  E  A  L  L  D  T  G  S  X>

570       580       590       600       610       620       630       640
          *         *         *         *         *         *         *         *
ACCGTCTTTCTTTGCATCCGTTGCATCTCSCGCGAGGAGTCTCGTCKYTCCTAGTGGTTATGGGATAGRGACTCGTTGGGG
 G  R  K  K  R  R  Q  R  R  X  A  P  Q  S  X  X  D  H  Q  Y  P  I  X  E  Q  P>

650       660       670       680       690       700       710       720
          *         *         *         *         *         *         *         *
AGRGGAAGAAATCCCTTTTGGACCGAAAGGKCCGTTCCAYTTCGGTCTCTCAAARGGTCGCTTGTCTGTYCTCGGTTATCG
 L  X  F  F  R  E  N  L  A  F  X  Q  G  X  A  R  E  F  X  S  E  Q  T  X  A  N  S>

730       740       750       760       770       780       790       800
          *         *         *         *         *         *         *         *
                                 CGAAAGCTCCGYCRTTCTGGGAYCTGGCACCAAAAACGCCGCTACTAG
RGGYGGAGGTCCTT
 X  X  S  R  K  S  P  Q  I  S  G  E  S  S  X  X  L  G  X  G  T  K  N  A  A  T  S>

810
          *
TGAATTCGCC

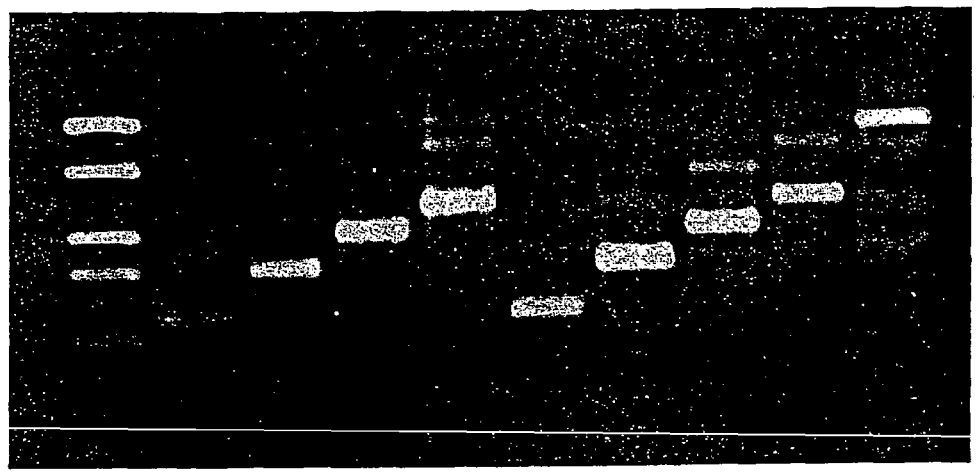
FIGURE 17

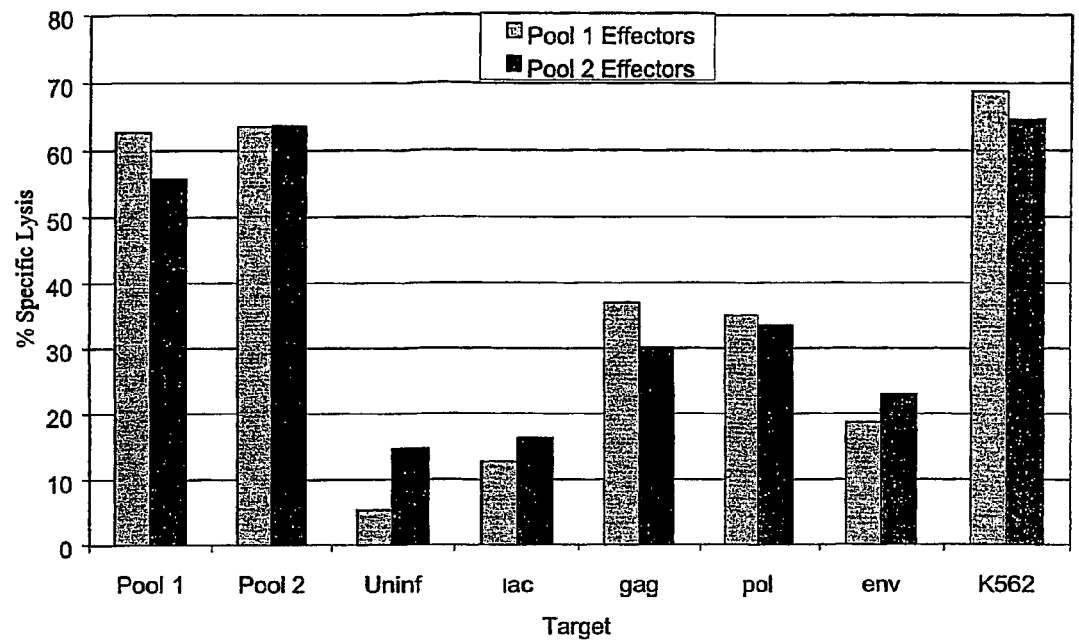
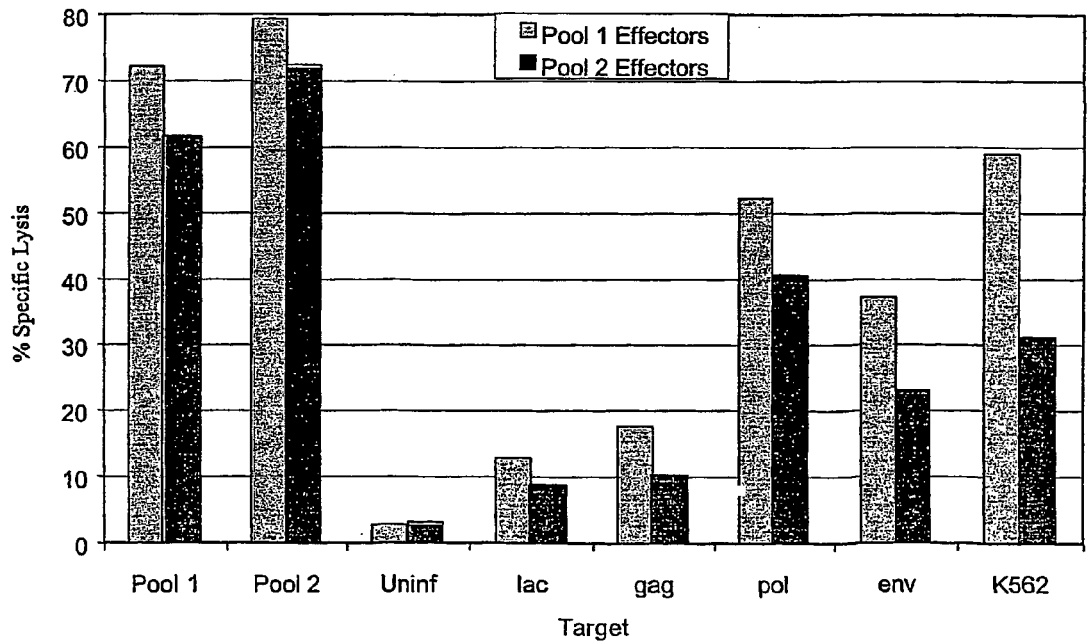
FIGURE 19

```
/* Scramble */

/* Includes */ include <stdio.h>
include <stdlib.h>
#include <string.h>
#include <time.h>

/* Constant definitions */

/* Version Information */
#define VERSION_NO                            "0.2"
#define VERSION_DATE                          "04/03/1999"

/* Misc */
#define KEYBOARD_BUFFER_SIZE     256              /*size of keyboard read buffer */
#define LEN_CODON                4                /*length of codon (including null) */
#define BUFFER_SIZE                       10000   /*size of file read buffer */
#define TRUE                              1       /*boolean true */
#define FALSE                             0       /*boolean false */

/* Error codes */
#define E_NOERROR                0                /*no error */
#define E_NOINFILE               1                /*genes file not found */
#define E_MALLOC                 2                /*memory allocation error */
#define E_FILEREAD               3                /*file read error */
#define E_CREATE_OUTPUT_FILE     4         /*error creating output file */
define E_OVERLAP                5                /*segment overlap >= length /* Structure definitions */ typedef struct gene GENE;
typedef GENE * P_GENE;
typedef struct gene_segment GENE_SEGMENT;
typedef GENE_SEGMENT * P_GENE_SEGMENT;
struct gene {
        char * name;
        char * data;
        P_GENE next_gene;
};

struct gene_segment {
        P_GENE p_gene;
        int number;
        int offset;
        int first_codon_choice;
        char * amino_data;
        char * dna_data;
        P_GENE_SEGMENT next_seg;
};
```

Figure 25

/* Function prototypes */

```c
int prolog();
int get_parameters();
int read_int(char * prompt);
int load_genes();
int add_gene(char * gene_name,char * gene_data);
void insert_gene(P_GENE * head,P_GENE new_gene);
int add_aa();
int split_genes();
int split_gene(P_GENE g);
int insert_segment(P_GENE_SEGMENT * head_seg,P_GENE_SEGMENT new_seg);
int convert_segments_aa_to_dna();
int convert_aa_to_dna(char * aa_ptr,char * dna_ptr,int first_choice);
char * codon(char acid_char,int preferred);
int perform_scramble();
int scramble_segments();
int adjacent_segments();
int display_genes();
int write_output_file();
void strip_newline(char * strip_str);
void pad_amino_string(char * amino_ptr, char * padded_ptr);
int even(int test_num);
void read_str(char * prompt,char * string);
char * read_nonblank_line(char * buf,int buf_size,FILE * in_file);
int user_confirmation();
void test();
```

/* Global variables */

```c
char * codon_table[26][2] = {
/* A 00 */ {"GCC","GCT"},
/* - 01 */ {"???","???"},
/* C 02 */ {"TGC","TGT"},
/* D 03 */ {"GAC","GAT"},
/* E 04 */ {"GAG","GAA"},
/* F 05 */ {"TTC","TTT"},
/* G 06 */ {"GGC","GGA"},
/* H 07 */ {"CAC","CAT"},
/* I 08 */ {"ATC","ATT"},
/* - 09 */ {"???","???"},
/* K 10 */ {"AAG","AAA"},
/* L 11 */ {"CTG","CTC"},
/* M 12 */ {"ATG","ATG"},
/* N 13 */ {"AAC","AAT"},
/* - 14 */ {"???","???"},
/* P 15 */ {"CCC","CCT"},
/* Q 16 */ {"CAG","CAA"},
/* R 17 */ {"AGG","AGA"},
/* S 18 */ {"AGC","TCC"},
/* T 19 */ {"ACC","ACA"},
/* - 20 */ {"???","???"},
/* V 21 */ {"GTG","GTC"},
/* W 22 */ {"TGG","TGG"},
```

Figure 25 (Cont)

```
/* - 23 */ {"???","???"},
/* Y 24 */ {"TAC","TAT"},
/* - 25 */ {"???","???"}
};

char * error_text[] = {
/* 00 */ "",
/* 01 */ ,"ERROR: Input file not found!"
/* 02 */ ,"ERROR: Memory allocation error"
/* 03 */ ,"ERROR: File read error"
/* 04 */ ,"ERROR: Could not create output file"
/* 05 */ ,"ERROR: Segment overlap must be less than segment length"
};

char disease_name[KEYBOARD_BUFFER_SIZE];
char input_file_name[KEYBOARD_BUFFER_SIZE];
char output_file_name[KEYBOARD_BUFFER_SIZE];
int num_genes = 0;
int num_segments = 0;
int len_segment;
int segment_overlap;
P_GENE first_gene = NULL;
P_GENE_SEGMENT first_segment = NULL;
P_GENE_SEGMENT * scrambled_segments = NULL;

/* Mainline */ void main() {
        int error = E_NOERROR;

printf("Scramble - Version %s, %s\n\n",VERSION_NO,VERSION_DATE);

/* Initial processing */
        if (!error)
                error = prolog();

/* Get various program parameters from user */
        if (!error)
                error = get_parameters();

/* Load genes from genes file */
        if (!error)
                error = load_genes();

/* Add 'AA' to start and end of all genes */
        if (!error)
                error = add_aa();

/* Split genes into overlapping chunks */
        if (!error)
                error = split_genes();

/* Convert segment amino acid to dna */
        if (!error)
                error = convert_segments_aa_to_dna();
```

Figure 25 (Cont)

```
/* Scramble the segments */
if (!error)
        error = perform_scramble();

/* Write output file */
if (!error)
        error = write_output_file();

/* Show error if there was one */
if (error)
        printf("%s\n",error_text[error]);
}

/* prolog() */
/* Perform any initial processing required */ int prolog() {

/* Seed the random number generator, using the system clock */
        /* Don't run the program more than once in the same second! */
        /* Or we'll get the same randomisation!!!!!!!!!!!!!!!!!!!!! */
        srand(time(NULL));

return E_NOERROR;
}

/* get_parameters() */
/* Ask for various parameters from the user (stdin) */
/*      Disease name                    */
/*      Input file name                 */
/*      Output file name                */
/*      Segment length                  */ int get_parameters() {
        int valid;

read_str("Enter disease name    : ",disease_name);
        read_str("Enter input file name : ",input_file_name);
        read_str("Enter output file name : ",output_file_name);

valid = FALSE;
        while (!valid) {
                len_segment = read_int("Enter segment length   : ");
                if (len_segment % 2)
                        printf("Segment length must be even!\n");
                else
                        valid = TRUE;
        }
        segment_overlap = len_segment / 2;

return E_NOERROR;
}

/* load_genes() */
```

Figure 25 (Cont)

```
/* Load the genes from the input file */ int load_genes() {
          FILE * input_file;
          char name_buf[BUFFER_SIZE];
          char data_buf[BUFFER_SIZE];
          int rc;

/* Open genes file for reading */
          if (NULL == (input_file = fopen(input_file_name,"r")))
                    return E_NOINFILE;

printf("Loading genes from: %s\n",input_file_name);
          num_genes = 0;
          /* Read gene name */
          while (NULL != read_nonblank_line(name_buf,BUFFER_SIZE,input_file)) {
                    /* Read the gene data */
                    if (NULL != read_nonblank_line(data_buf,BUFFER_SIZE,input_file)) {
                              /* Allocate memory for new gene and add to list */
                              if (rc = add_gene(name_buf,data_buf))
                                        break;
                    }
          }
          /* Close genes file */
          fclose(input_file);

return rc;
}

/* add_gene() */
/* Allocate memory for new gene, then insert in list */ int add_gene(char * gene_name,char * gene_data) {
          P_GENE new_gene;

/* Allocate storage for new gene */
          if (NULL == (new_gene = malloc(sizeof(GENE))))
                    return E_MALLOC;
          /* Initialise new gene */
          new_gene->next_gene = NULL;
          /* Allocate storage for gene name (+1 for null) */
          if (NULL == (new_gene->name = malloc(strlen(gene_name)+1)))
                    return E_MALLOC;
          /* Store gene name */
          strcpy(new_gene->name,gene_name);
          /* Allocate storage for gene data (+1 for null) */
          if (NULL == (new_gene->data = malloc(strlen(gene_data)+1)))
                    return E_MALLOC;
          /* Store gene data */
          strcpy(new_gene->data,gene_data);
          /* Insert the new gene into linked list */
          insert_gene(&first_gene,new_gene);
          /* Increment num_genes */
          num_genes++;
```

Figure 25 (Cont)

```
                return E_NOERROR;
}

/* insert_gene() */
/* Insert gene into linked list */ void insert_gene(P_GENE * head_gene,P_GENE new_gene) {
        P_GENE * cur_ptr = head_gene;

while (NULL != (*cur_ptr))
                cur_ptr = &((*cur_ptr)->next_gene);

*cur_ptr = new_gene;
}

/* add_aa() */
/* Add 'AA' to the start and end of every gene */ int add_aa() {
        P_GENE cur_gene = first_gene;
        char * new_data;

while (NULL != cur_gene) {
                        /* Allocate storage to fit the gene plus four characters */
                        new_data = malloc(strlen(cur_gene->data)+5);
                        /* Shift gene data to new storage, add "AA" */
                        strcpy(new_data,"AA");
                        strcat(new_data,cur_gene->data);
                        strcat(new_data,"AA");
                        /* Free previous gene data storage */
                        free(cur_gene->data);
                        /* Set gene data pointer to new storage */
                        cur_gene->data = new_data;
                        /* Advance to next gene */
                        cur_gene = cur_gene->next_gene;
        } return E_NOERROR;
}

/* split_genes() */
/* Split the genes into overlapping segments */ int split_genes() {
        P_GENE cur_gene = first_gene;
        P_GENE_SEGMENT cur_seg = first_segment;

printf("Splitting genes into segments...\n");

/* Split the genes into segments */
        while (NULL != cur_gene) {
                        /* Split the gene */
                        split_gene(cur_gene);
                        /* Advance to next gene */
```

Figure 25 (Cont)

```
                    cur_gene = cur_gene->next_gene;
          }

/* Count the number of segments */
          num_segments = 0;
          cur_seg = first_segment;
          while (NULL != cur_seg) {
                    num_segments++;
                    cur_seg = cur_seg->next_seg;
          } return E_NOERROR;
}

/* split_gene() */
/* Split a gene into overlapping segments */ int split_gene(P_GENE g) {
          char * seg_ptr;
          char * seg_buf;
          P_GENE_SEGMENT new_segment = NULL;
          int done;
          int seg_ctr = 0;

/* Allocate memory for segment buffer */
          if (NULL == (seg_buf = malloc(len_segment+1)))
                    return E_MALLOC;

/* Insert a null at the end of the segment buffer, */
          /* so we can use it as a string */
          seg_buf[len_segment] = '\0';

/* Set segment pointer to start of gene data */
          seg_ptr = g->data;

done = FALSE;
          while (!(done)) {
                    /* So we know if we copied data */
                    seg_buf[0] = '\0';

/* Copy a segment of gene data to the segment buffer */
                    memcpy(seg_buf,seg_ptr,len_segment);

/* If there was some gene data copied to the buffer */
                    if (NULL != seg_buf[0]) {
                              /* Allocate storage for a new segment */
                              if (NULL == (new_segment = malloc(sizeof(GENE_SEGMENT))))
                                        return E_MALLOC;
                              /* Increment segment counter */
                              seg_ctr++;
                              /* Setup the new segment */
                              new_segment->p_gene  = g;
                              new_segment->number  = seg_ctr;
                              new_segment->offset  = seg_ptr - g->data + 1;
                              new_segment->next_seg = NULL;
```

Figure 25 (Cont)

```
                    if (NULL == (new_segment->amino_data = malloc(len_segment+1)))
                            return E_MALLOC;
                    if (NULL == (new_segment->dna_data = malloc(len_segment*3+1)))
                            return E_MALLOC;
                    new_segment->amino_data[0] = '\0';
                    new_segment->dna_data[0]   = '\0';
                    /* Copy segment data from buffer to new segment */
                    strcpy(new_segment->amino_data,seg_buf);
                    /* Insert new segment into chain from gene */
                    insert_segment(&first_segment,new_segment);
            }

/* If we didn't read a full segment, we are finished! */
            if (strlen(seg_buf) < len_segment)
                    done = TRUE;
            /* Otherwise, advance segment pointer to next segment in buffer */
            else
                    seg_ptr = seg_ptr + len_segment - segment_overlap;
        }
}

/* insert_segment() */
/* Insert a segment node at the end of the list */ int insert_segment(P_GENE_SEGMENT * head_seg,P_GENE_SEGMENT new_seg) {
        P_GENE_SEGMENT * cur_ptr = head_seg;

while (NULL != (*cur_ptr))
                cur_ptr = &((*cur_ptr)->next_seg);

*cur_ptr = new_seg;
}

/* convert_segments_aa_to_dna */
/* Go thru segments, and for each, convert amino acids to dna */ int convert_segments_aa_to_dna() {
        P_GENE_SEGMENT cur_seg = first_segment;
        int first_choice = 1;
        int alternate;

printf("Converting to DNA...\n");

/* Work out if we need to alternate the first codon choice or not */
        /* Don't need to do this anymore, since the segment length is    */
        /* forced to be even, and the overlap is half the length (odd).  */
        /*alternate = ((even(len_segment) && even(segment_overlap))
                        || (!even(len_segment) && !even(segment_overlap)));*/
        alternate = FALSE;

while (NULL != cur_seg) {
                cur_seg->first_codon_choice = first_choice;
                convert_aa_to_dna(cur_seg->amino_data,cur_seg->dna_data,
                                        cur_seg->first_codon_choice);
```

Figure 25 (Cont)

```c
            /* Address next segment */
            cur_seg = cur_seg->next_seg;

/* If we are alternating, alternate the first codon choice */
            /*if (alternate)
                        if (1 == first_choice)
                                    first_choice = 2;
                        else
                                    first_choice = 1;*/
    } return E_NOERROR;
}

/* convert_aa_to_dna */
/* Converts a string of amino acid to dna */
/* NOTE: assumes that buffer at dna_ptr is large enough to hold dna!!! */ int convert_aa_to_dna(char * aa_ptr,char * dna_ptr,int first_choice) {
            char * p_codon;
            int cur_preferred = first_choice;

while ('\0' != *aa_ptr) {
                        p_codon = codon(*aa_ptr,cur_preferred);
                        strcat(dna_ptr,p_codon);
                        /* If we didn't find a codon, log a warning */
                        if (0 == strcmp(p_codon,"???\0"))
                                    printf("WARNING: no codon found for amino acid!\n");

/* Alternate current preferred codon */
                        if (1 == cur_preferred)
                                    cur_preferred = 2;
                        else
                                    cur_preferred = 1;

aa_ptr++;
            } return E_NOERROR;
}

/* codon */
/* Returns a pointer to a codon corresponding to the amino acid passed */
/* The codon pointer is to 3 characters, plus a terminating null */ char * codon(char acid_char,int preferred) {
            int codon_table_index;
            char * codon_ptr;

/* Determine index into codon_table (table starts at 'A') */
            codon_table_index = acid_char - 'A';

/* Set pointer to appropriate codon */
            codon_ptr = codon_table[codon_table_index][preferred-1];
```

Figure 25 (Cont)

```
                return codon_ptr;
}

/* display_genes() */
/* Display the name and data for all genes */ int display_genes() {
        P_GENE cur_gene = first_gene;

while (NULL != cur_gene) {
                printf("%s\n",cur_gene->name);
                printf("%s\n",cur_gene->data);
                cur_gene = cur_gene->next_gene;
        } return E_NOERROR;
}

/* perform_scramble() */
/* Scramble the segments */
/* Check for adjacent segments. If there are, rescramble */ int perform_scramble() {
        int done = FALSE;
        int rc = E_NOERROR;

while (TRUE) {
                rc = scramble_segments();
                if (E_NOERROR == rc)
                        if (adjacent_segments()) {
                                printf("Adjacent segments detected! Rescramble? (y/n) ");
                                if (!user_confirmation()) {
                                        printf("WARNING: Adjacent segments in output file.\n");
                                        break;
                                }
                        }
                        else
                                break;
                else
                        break;
        } return rc;
}

/* scramble_segments() */
/* Randomly scramble the segments, putting pointers in scrambled_segments[] */ int scramble_segments() {
        P_GENE_SEGMENT cur_seg = first_segment;
        int i,j;
        P_GENE_SEGMENT temp;

printf("Scrambling segments...\n");
```

Figure 25 (Cont)

```
        /* Allocate storage for array of segment pointers */
        if (NULL == (scrambled_segments = malloc(sizeof(P_GENE_SEGMENT)*num_segments)))
                return E_MALLOC;

/* First, initialise scrambled_segments in same order as linked list */
        i = 0;
        while (cur_seg != NULL) {
                scrambled_segments[i] = cur_seg;
                cur_seg = cur_seg->next_seg;
                i++;
        }

/* Now, randomly scramble the segments */
        for (i=0;i<num_segments;i++) {
                j          = rand() % num_segments;
                temp       = scrambled_segments[i];
                scrambled_segments[i] = scrambled_segments[j];
                scrambled_segments[j] = temp;
        } return E_NOERROR;
}

/* adjacent_segments() */
/* Determine if the scrambled segment order has resulted in */
/* two segments which were adjacent originally (ie every    */
/* second one) have ended up adjacent.                      */ int adjacent_segments() {
        int i;
        int rc = 0;
        P_GENE_SEGMENT cur_seg;
        P_GENE_SEGMENT next_seg;

for (i=0;i<num_segments-1;i++) {
                /* Address current and next segments */
                cur_seg  = scrambled_segments[i];
                next_seg = scrambled_segments[i+1];
                /* Do segments come from same gene, and are two apart? */
                if (((cur_seg->p_gene == next_seg->p_gene)
                        && ((cur_seg->number == (next_seg->number)+2)
                                || (cur_seg->number == (next_seg->number)-2))))
                                        return 1;
        }
        return 0;
}

/* write_output_file() */
/* Write out segments (in initial non-scrambled order) */
/* Write out synthetic protein (in scrambled order) */
/* Write out synthetic dna (in scrambled order) */ int write_output_file() {
        FILE * output_file;
```

Figure 25 (Cont)

```
char * amino_buffer;
P_GENE_SEGMENT cur_seg;
int i;

/* Open output file for writing (erase any contents) */
if (NULL == (output_file = fopen(output_file_name,"w")))
        return E_CREATE_OUTPUT_FILE;

/* Allocate memory for padded amino string buffer */
if (NULL == (amino_buffer = malloc(len_segment*3+1)))
        return E_MALLOC;

printf("Writing output file: %s\n",output_file_name);

/* Write output file header information */
fprintf(output_file,"Scramble %s - Output File\n",VERSION_NO);
fprintf(output_file,"\n");
fprintf(output_file,"Disease name    : %s\n",disease_name);
fprintf(output_file,"Input filename  : %s\n",input_file_name);
fprintf(output_file,"Output filename : %s\n",output_file_name);
fprintf(output_file,"Number genes    : %d\n",num_genes);
fprintf(output_file,"Number segments : %d\n",num_segments);
fprintf(output_file,"Segment length  : %d\n",len_segment);
fprintf(output_file,"Segment overlap : %d\n",segment_overlap);

/* Write out segments in initial non-scrambled order */
fprintf(output_file,"\n");
fprintf(output_file,"Segments in original order:\n");
fprintf(output_file,"-------------------------------\n");
cur_seg = first_segment;
while (NULL != cur_seg) {
        /* Format amino data to line up with codons */
        pad_amino_string(cur_seg->amino_data,amino_buffer);
        fprintf(output_file,"Gene     : %s\n",cur_seg->p_gene->name);
        fprintf(output_file,"Segment# : %d\n",cur_seg->number);
        fprintf(output_file,"Offset   : %d\n",cur_seg->offset);
        fprintf(output_file,"1st Codon : %d\n",cur_seg->first_codon_choice);
        fprintf(output_file,"%s\n",amino_buffer);
        fprintf(output_file,"%s\n",cur_seg->dna_data);
        fprintf(output_file,"\n");
        cur_seg = cur_seg->next_seg;
}

/* Write out segment names in scrambled order */
fprintf(output_file,"Segments in scrambled order:\n");
fprintf(output_file,"-------------------------------\n");
for (i=0;i<num_segments;i++) {
        /* Format amino data to line up with codons */
        pad_amino_string(scrambled_segments[i]->amino_data,amino_buffer);
        /* Write segment details */
        fprintf(output_file,"%s #%d\n",scrambled_segments[i]->p_gene->name,
                scrambled_segments[i]->number);
        fprintf(output_file,"%s\n",amino_buffer);
        fprintf(output_file,"%s\n",scrambled_segments[i]->dna_data);
        fprintf(output_file,"\n");
```

/* Write synthetic protein in one long string */
            fprintf(output_file,"Synthetic Protein:\n");
            fprintf(output_file,"--------------------\n");
            for (i=0;i<num_segments;i++)
                    fprintf(output_file,"%s",scrambled_segments[i]->amino_data);

fprintf(output_file,"\n\n");

/* Write synthetic dna in one long string */
            fprintf(output_file,"Synthetic DNA:\n");
            fprintf(output_file,"--------------\n");
            for (i=0;i<num_segments;i++)
                    fprintf(output_file,"%s",scrambled_segments[i]->dna_data);

return E_NOERROR;
}

/* strip_newline() */
/* Replace the first newline character with a null */ void strip_newline(char * strip_str) {
        char * newline_pos;

/* Find the newline char */
        newline_pos = strchr(strip_str,'\n');

/* If we found one, replace it with a null */
        if (NULL != newline_pos)
                newline_pos[0] = '\0';
}

/* pad_amino_string */
/* Copy amino chars from amino_ptr to padded_ptr, padding each */
/* side with a space. */ void pad_amino_string(char * amino_ptr, char * padded_ptr) { while ('\0' != *amino_ptr) {
                *padded_ptr = ' ';
                padded_ptr++;
                *padded_ptr = *amino_ptr;
                padded_ptr++;
                *padded_ptr = ' ';
                padded_ptr++;
                amino_ptr++;
        }

/* Stick a null at the end of the padded string */
        *padded_ptr = '\0';
}

/* even() */
/* True if test_num is even, otherwise false */
```

Figure 25 (Cont)

```
int even(int test_num) {
          return !(test_num % 2);
}

/* read_int() */
/* Read an integer from stdin. Keep trying until valid int > 0 entered. */
/* Return the integer read, or 0 if error reading from stdin. */ int read_int(char * prompt) {
          char buffer[KEYBOARD_BUFFER_SIZE];
          int value_read;
          int valid = FALSE;

while (!valid) {
                    printf("%s",prompt);
                    valid = TRUE;
                    fgets(buffer,KEYBOARD_BUFFER_SIZE,stdin);
                    if (1 != sscanf(buffer,"%d",&value_read))
                              valid = FALSE;
                    if (valid && (value_read < 1))
                              valid = FALSE;
                    if (!valid)
                              printf("Positive integer value please!\n");
          } return value_read;
}

/* read_str() */
/* Read a string from the user (stdin) */
/* Strip the newline from it */ void read_str(char * prompt,char * string) {
          char buffer[KEYBOARD_BUFFER_SIZE];

printf(prompt);
          fgets(buffer,KEYBOARD_BUFFER_SIZE,stdin);
          sscanf(buffer,"%s",string);
}

/* read_nonblank_line() */
/* Read a line from file until we get a non-blank one */ char * read_nonblank_line(char * buf,int buf_size,FILE * in_file) {
          char * return_ptr;

/* Read lines until we get a non-black one, or EOF */
          do
                    return_ptr = fgets(buf,buf_size,in_file);
          while ((NULL != return_ptr) && (('\n' == buf[0]) || (' ' == buf[0])));

/* If we got a line, change the newline char to a null */
          if (NULL != return_ptr)
                    strip_newline(buf);
```

Figure 25 (Cont)

```
                return return_ptr;
}

/* user_confirmation() */
/* Read input from user. If user types 'y', return 1, otherwise 0 */ int user_confirmation() {
        char buffer[KEYBOARD_BUFFER_SIZE];

fgets(buffer,KEYBOARD_BUFFER_SIZE,stdin);
        if (('y' == buffer[0]) || ('Y' == buffer[0]))
                return 1;
        else
                return 0;
}

/* test() */
/* For debugging/development */ void test() {
        char str[100];
        printf("Enter something: ");
        fgets(str,100,stdin);
        printf("line1\n");
        printf("%s",str);
        printf("line2\n");
        fgets(str,100,stdin);
}
```

Figure 25 (Cont)

HepC Savine design

HepC 1a consensus polyprotein sequence used for scramble program

```
MSTNPKPQRKTKRNTNRRPQDVKFPGGGQIVGGVYLLPRRGPRLGVRATRKTSERSQPRGRRQPIPKARRPEGRTWAQ
PGYPWPLYGNEGCGWAGWLLSPRGSRPSWGPTDPRRRSRNLGKVIDTLTCGFADLMGYIPLVGAPLGGAARALAHGVR
VLEDGVNYATGNLPGCSFSIFLLALLSCLTVPASAYQVRNSTGLYHVTNDCPNSSIVYEAADAILHTPGCVPCVREGN
ASRCWVAMTPTVATRDGKLPATQLRRHIDLLVGSATLCSALYVGDLCGSVFLVGQLFTFSPRRHWTTQGCNCSIYPGH
ITGHRMAWDMMMNWSPTAALVMAQLLRIPQAILDMIAGAHWGVLAGIAYFSMVGNWAKVLVVLLLFAGVDAETHVTGG
NAGRTTSGLVSLLTPGAKQNIQLINTNGSWHINSTALNCNESLNTGWLAGLFYQHKFNSSGCPERLASCRRLTDFDQG
WGPISYANGSGPDQRPYCWHYPPKPCGIVPAKSVCGPVYCFTPSPVVVGTTDRSGAPTYSWGANDTDVFVLNNTRPPL
GNWFGCTWMNSTGFTKVCGAPPCVIGGAGNNTLHCPTDCFRKHPEATYSRCGSGPWITPRCLVDYPYRLWHYPCTINY
TIFKVRMYVGGVEHRLEAACNWTRGERCDLEDRDRSELSPLLLSTTQWQVLPCSFTTLPALSTGLIHLHQNIVDVQYL
YGVGSSIASWAIKWEYVVLLFLLLADARVCSCLWMMLLISQAEAALENLVILNAASLAGTHGLVSFLVFFCFAWYLKG
RWVPGAVYALYGMWPLLLLLLALPQRAYALDTEVAASCGGVVLVGLMALTLSPYYKRYISWCLWWLQYFLTRVEAQLH
VWVPPLNVRGGRDAVILLMCVVHPTLVFDITKLLLAVFGPLWILQASLLKVPYFVRVQGLLRICALARKMIGGHYVQM
AIIKLGALTGTYVYNHLTPLRDWAHNGLRDLAVAVEPVVFSQMETKLITWGADTAACGDIINGLPVSARRGREILLGP
ADGMVSKGWRLLAPITAYAQQTRGLLGCIITSLTGRDKNQVEGEVQIVSTAAQTFLATCINGVCWTVYHGAGTRTIAS
PKGPVIQMYTNVDQDLVGWPAPQGSRSLTPCTCGSSDLYLVTRHADVIPVRRRGDSRGSLLSPRPISYLKGSSGGPLL
CPAGHAVGIFRAAVCTRGVAKAVDFIPVENLETTMRSPVFTDNSSPPAVPQSFQVAHLHAPTGSGKSTKVPAAYAAQG
YKVLVLNPSVAATLGFGAYMSKAHGIDPNIRTGVRTITTGSPITYSTYGKFLADGGCSGGAYDIIICDECHSTDATSI
LGIGTVLDQAETAGARLVVLATATPPGSVTVPHPNIEEVALSTTGEIPFYGKAIPLEVIKGGRHLIFCHSKKKCDELA
AKLVALGINAVAYYRGLDVSVIPTSGDVVVVATDALMTGYTGDFDSVIDCNTCVTQTVDFSLDPTFTIETTTLPQDAV
SRTQRRGRTGRGKPGIYRFVAPGERPSGMFDSSVLCECYDAGCAWYELTPAETTVRLRAYMNTPGLPVCQDHLEFWEG
VFTGLTHIDAHFLSQTKQSGENFPYLVAYQATVCARAQAPPPSWDQMWKCLIRLKPTLHGPTPLLYRLGAVQNEVTLT
HPVTKYIMTCMSADLEVVTSTWVLVGGVLAALAAYCLSTGCVVIVGRIVLSGKPAIIPDREVLYREFDEMEECSQHLP
YIEQGMMLAEQFKQKALGLLQTASRQAEVIAPAVQTNWQKLEVFWAKHMWNFISGIQYLAGLSTLPGNPAIASLMAFT
AAVTSPLTTSQTLLFNILGGWVAAQLAAPGAATAFVGAGLAGAAIGSVGLGKVLVDILAGYGAGVAGALVAFKIMSGE
VPSTEDLVNLLPAILSPGALVVGVVCAAILRRHVGPGEGAVQWMNRLIAFASRGNHVSPTHYVPESDAAARVTAILSS
LTVTQLLRRLHQWISSECTTPCSGSWLRDIWDWICEVLSDFKTWLKAKLMPQLPGIPFVSCQRGYKGVWRGDGIMHTR
CHCGAEITGHVKNGTMRIVGPRTCRNMWSGTFPINAYTTGPCTPLPAPNYTFALWRVSAEEYVEIRRVGDFHYVTGMT
TDNLKCPCQVPSPEFFTELDGVRLHRFAPPCKPLLREEVSFRVGLHEYPVGSQLPCEPEPDVAVLTSMLTDPSHITAE
AAGRRLARGSPPSMASSSASQLSAPSLKATCTANHDSPDAELIEANLLWRQEMGGNITRVESENKVVILDSFDPLVAE
EDEREISVPAEILRKSRRFAQALPVWARPDYNPPLVETWKKPDYEPPVVHGCPLPPPRSPPVPPPRKKRTVVLTESTL
STALAELATKSFGSSSTSGITGDNTTTSSEPAPSGCPPDSDAESYSSMPPLEGEPGDPDLSDGSWSTVSSEAGTEDVV
CCSMSYSWTGALVTPCAAEEQKLPINALSNSLLRHHNLVYSTTSRSACQRQKKVTFDRLQVLDSHYQDVLKEVKAAAS
KVKANLLSVEEACSLTPPHSAKSKFGYGAKDVRCHARKAVAHINSVWKDLLEDSVTPIDTTIMAKNEVFCVQPEKGGR
KPARLIVFPDLGVRVCEKMALYDVVSKLPLAVMGSSYGFQYSPGQRVEFLVQAWKSKKTPMGFSYDTRCFDSTVTESD
IRTEEAIYQCCDLDPQARVAIKSLTERLYVGGPLTNSRGENCGYRRCRASGVLTTSCGNTLTCYIKARAACRAAGLQD
CTMLVCGDDLVVICESAGVQEDAASLRAFTEAMTRYSAPPGDPPQPEYDLELITSCSSNVSVAHDGAGKRVYYLTRDP
TTPLARAAWETARHTPVNSWLGNIIMFAPTLWARMILMTHFFSVLIARDQLEQALDCEIYGACYSIEPLDLPPIIQRL
HGLSAFSLHSYSPGEINRVAACLRKLGVPPLRAWRHRARSVRARLLARGGRAAICGKYLFNWAVRTKLKLTPIAAAGR
LDLSGWFTAGYSGGDIYHSVSHARPRWFWFCLLLLAAGVGIYLLPNR
```

```
Scramble - Output File

Scramble version : 0.1 beta, 08/02/1999
Num. genes       : 1
Num. segments    : 201
Segment length   : 30
Segment overlap  : 15

Segments in original order:
---------------------------
Gene       : HepC1a
Segment#   : 1
Offset     : 1
1st Codon  : 1
 A  A  M  S  T  N  P  K  P  Q  R  K  T  K  R  N  T  N  R  R  P  Q  D  V  K  F  P  G  G  G
GCCGCTATGTCCACCAATCCCAAACCCCAAAGGAAAACCAAAAGGAATACCAATAGGAGACCCCAAGACGTCAAGTTTCCCGGAGGCGGA
```

Figure 26

```
Gene       : HepC1a
Segment#   : 2
Offset     : 16
1st Codon  : 1
 N  T  N  R  R  P  Q  D  V  K  F  P  G  G  G  Q  I  V  G  G  V  Y  L  L  P  R  R  G  P  R
AACACAAACAGAAGGCCTCAGGATGTGAAATTCCCTGGCGGAGGCCAAATCGTCGGCGGAGTGTATCTGCTCCCCAGAAGGGGACCCAGA Gene       : HepC1a
Segment#   : 3
Offset     : 31
1st Codon  : 1
 Q  I  V  G  G  V  Y  L  L  P  R  R  G  P  R  L  G  V  R  A  T  R  K  T  S  E  R  S  Q  P
CAGATTGTGGGAGGCGTCTACCTCCTGCCTAGGAGAGGCCCTAGGCTCGGCGTCAGGGCTACCAGAAAGACAAGCGAAAGGTCCCAGCCT Gene       : HepC1a
Segment#   : 4
Offset     : 46
1st Codon  : 1
 L  G  V  R  A  T  R  K  T  S  E  R  S  Q  P  R  G  R  R  Q  P  I  P  K  A  R  R  P  E  G
CTGGGAGTGAGAGCCACAAGGAAAACCTCCGAGAGAAGCCAACCCAGAGGCAGAAGGCAACCCATTCCCAAAGCCAGAAGGCCTGAGGGA Gene       : HepC1a
Segment#   : 5
Offset     : 61
1st Codon  : 1
 R  G  R  R  Q  P  I  P  K  A  R  R  P  E  G  R  T  W  A  Q  P  G  Y  P  W  P  L  Y  G  N
AGGGGAAGGAGACAGCCTATCCCTAAGGCTAGGAGACCCGAAGGCAGAACCTGGGCCCAACCCGGATACCCTTGGCCTCTGTATGGCAAT Gene       : HepC1a
Segment#   : 6
Offset     : 76
1st Codon  : 1
 R  T  W  A  Q  P  G  Y  P  W  P  L  Y  G  N  E  G  C  G  W  A  G  W  L  L  S  P  R  G  S
AGGACATGGGCTCAGCCTGGCTATCCCTGGCCCCTCTACGGAAACGAAGGCTGTGGCTGGGCCGGATGGCTCCTGTCCCCCAGAGGCTCC Gene       : HepC1a
Segment#   : 7
Offset     : 91
1st Codon  : 1
 E  G  C  G  W  A  G  W  L  L  S  P  R  G  S  R  P  S  W  G  P  T  D  P  R  R  R  S  R  N
GAGGGATGCGGATGGGCTGGCTGGCTGCTCAGCCCTAGGGGAAGCAGACCCTCCTGGGGACCCACAGACCCTAGGAGAAGGTCCAGGAAT Gene       : HepC1a
Segment#   : 8
Offset     : 106
1st Codon  : 1
 R  P  S  W  G  P  T  D  P  R  R  R  S  R  N  L  G  K  V  I  D  T  L  T  C  G  F  A  D  L
AGGCCTAGCTGGGGCCCTACCGATCCCAGAAGGAGAAGCAGAAACCTCGGCAAAGTGATTGACACACTGACATGCGGATTCGCTGACCTC Gene       : HepC1a
Segment#   : 9
Offset     : 121
1st Codon  : 1
 L  G  K  V  I  D  T  L  T  C  G  F  A  D  L  M  G  Y  I  P  L  V  G  A  P  L  G  G  A  A
CTGGGAAAGGTCATCGATACCCTCACCTGTGGCTTTGCCGATCTGATGGGCTATATCCCTCTGGTCGGCGCTCCCCTCGGCGGAGCCGCT Gene       : HepC1a
Segment#   : 10
Offset     : 136
1st Codon  : 1
 M  G  Y  I  P  L  V  G  A  P  L  G  G  A  A  R  A  L  A  H  G  V  R  V  L  E  D  G  V  N
ATGGGATACATTCCCCTCGTGGGAGCCCCTCTGGGAGGCGCTGCCAGAGCCCTCGCCCATGGCGTCAGGGTCCTGGAAGACGGAGTGAAT Gene       : HepC1a
Segment#   : 11
Offset     : 151
1st Codon  : 1
 R  A  L  A  H  G  V  R  V  L  E  D  G  V  N  Y  A  T  G  N  L  P  G  C  S  F  S  I  F  L
AGGGCTCTGGCTCACGGAGTGAGAGTGCTCGAGGATGGCGTCAACTATGCCACAGGCAATCTGCCTGGCTGTAGCTTTAGCATTTTCCTC Gene       : HepC1a
Segment#   : 12
Offset     : 166
```

Figure 26 (cont)

```
1st Codon : 1
 Y  A  T  G  N  L  P  G  C  S  F  S  I  F  L  L  A  L  L  S  C  L  T  V  P  A  S  A  Y  Q
TACGCTACCGGAAACCTCCCCGGATGCTCCTTCTCCATCTTTCTGCTCGCCCTCCTGTCCTGCCTCACCGTCCCCGCTAGCGCTTACCAA Gene       : HepC1a
Segment#   : 13
Offset     : 181
1st Codon : 1
 L  A  L  L  S  C  L  T  V  P  A  S  A  Y  Q  V  R  N  S  T  G  L  Y  H  V  T  N  D  C  P
CTGGCTCTGCTCAGCTGTCTGACAGTGCCTGCCTCCGCCTATCAGGTCAGGAATAGCACAGGCCTCTACCATGTGACAAACGATTGCCCT Gene       : HepC1a
Segment#   : 14
Offset     : 196
1st Codon : 1
 V  R  N  S  T  G  L  Y  H  V  T  N  D  C  P  N  S  S  I  V  Y  E  A  A  D  A  I  L  H  T
GTGAGAAACTCCACCGGACTGTATCACGTCACCAATGACTGTCCCAATAGCTCCATCGTCTACGAAGCCGCTGACGCTATCCTCCACACA Gene       : HepC1a
Segment#   : 15
Offset     : 211
1st Codon : 1
 N  S  S  I  V  Y  E  A  A  D  A  I  L  H  T  P  G  C  V  P  C  V  R  E  G  N  A  S  R  C
AACTCCAGCATTGTGTATGAGGCTGCCGATGCCATTCTGCATACCCCTGGCTGTGTGCCTTGCGTCAGGGAAGGCAATGCCTCCAGGTGT Gene       : HepC1a
Segment#   : 16
Offset     : 226
1st Codon : 1
 P  G  C  V  P  C  V  R  E  G  N  A  S  R  C  W  V  A  M  T  P  T  V  A  T  R  D  G  K  L
CCCGGATGCGTCCCCTGTGTGAGAGAGGGAAACGCTAGCAGATGCTGGGTGGCTATGACACCCACAGTGGCTACCAGAGACGGAAAGCTC Gene       : HepC1a
Segment#   : 17
Offset     : 241
1st Codon : 1
 W  V  A  M  T  P  T  V  A  T  R  D  G  K  L  P  A  T  Q  L  R  R  H  I  D  L  L  V  G  S
TGGGTCGCCATGACCCCTACCGTCGCCACAAGGGATGGCAAACTGCCTGCCACACAGCTCAGGAGACACATTGACCTCCTGGTCGGCTCC Gene       : HepC1a
Segment#   : 18
Offset     : 256
1st Codon : 1
 P  A  T  Q  L  R  R  H  I  D  L  L  V  G  S  A  T  L  C  S  A  L  Y  V  G  D  L  C  G  S
CCCGCTACCCAACTGAGAAGGCATATCGATCTGCTCGTGGGAAGCGCTACCCTCTGCTCCGCCCTCTACGTCGGCGATCTGTGTGGCTCC Gene       : HepC1a
Segment#   : 19
Offset     : 271
1st Codon : 1
 A  T  L  C  S  A  L  Y  V  G  D  L  C  G  S  V  F  L  V  G  Q  L  F  T  F  S  P  R  R  H
GCCACACTGTGTAGCGCTCTGTATGTGGGAGACCTCTGCGGAAGCGTCTTCCTCGTGGGACAGCTCTTCACATTCTCCCCCAGAAGGCAT Gene       : HepC1a
Segment#   : 20
Offset     : 286
1st Codon : 1
 V  F  L  V  G  Q  L  F  T  F  S  P  R  R  H  W  T  T  Q  G  C  N  C  S  I  Y  P  G  H  I
GTGTTTCTGGTCGGCCAACTGTTTACCTTTAGCCCTAGGAGACACTGGACCACACAGGGATGCAATTGCTCCATCTATCCCGGACACATT Gene       : HepC1a
Segment#   : 21
Offset     : 301
1st Codon : 1
 W  T  T  Q  G  C  N  C  S  I  Y  P  G  H  I  T  G  H  R  M  A  W  D  M  M  M  N  W  S  P
TGGACAACCCAAGGCTGTAACTGTAGCATTTACCCTGGCCATATCACAGGCCATAGGATGGCCTGGGACATGATGATGAACTGGAGCCCT Gene       : HepC1a
Segment#   : 22
Offset     : 316
1st Codon : 1
 T  G  H  R  M  A  W  D  M  M  M  N  W  S  P  T  A  A  L  V  M  A  Q  L  L  R  I  P  Q  A
ACCGGACACAGAATGGCTTGGGATATGATGATGAATTGGTCCCCCACAGCCGCTCTGGTCATGGCTCAGCTCCTGAGAATCCCTCAGGCT
```

Figure 26 (Cont)

```
Gene       : HepC1a
Segment#   : 23
Offset     : 331
1st Codon  : 1
  T  A  A  L  V  M  A  Q  L  L  R  I  P  Q  A  I  L  D  M  I  A  G  A  H  W  G  V  L  A  G
ACCGCTGCCCTCGTGATGGCCCAACTGCTCAGGATTCCCCAAGCCATTCTGGATATGATTGCCGGAGCCCATTGGGGAGTGCTCGCCGGA Gene       : HepC1a
Segment#   : 24
Offset     : 346
1st Codon  : 1
  I  L  D  M  I  A  G  A  H  W  G  V  L  A  G  I  A  Y  F  S  M  V  G  N  W  A  K  V  L  V
ATCCTCGACATGATCGCTGGCGCTCACTGGGGCGTCCTGGCTGGCATTGCCTATTTCTCCATGGTCGGCAATTGGGCTAAGGTCCTGGTC Gene       : HepC1a
Segment#   : 25
Offset     : 361
1st Codon  : 1
  I  A  Y  F  S  M  V  G  N  W  A  K  V  L  V  V  L  L  L  F  A  G  V  D  A  E  T  H  V  T
ATCGCTTACTTTAGCATGGTGGGAAACTGGGCCAAAGTGCTCGTGGTCCTGCTCCTGTTTGCCGGAGTGGATGCCGAAACCCATGTGACA Gene       : HepC1a
Segment#   : 26
Offset     : 376
1st Codon  : 1
  V  L  L  L  F  A  G  V  D  A  E  T  H  V  T  G  G  N  A  G  R  T  T  S  G  L  V  S  L  L
GTGCTCCTGCTCTTCGCTGGCGTCGACGCTGAGACACACGTCACCGGAGGCAATGCCGGAAGGACAACCTCCGGCCTCGTGTCCCTGCTC Gene       : HepC1a
Segment#   : 27
Offset     : 391
1st Codon  : 1
  G  G  N  A  G  R  T  T  S  G  L  V  S  L  L  T  P  G  A  K  Q  N  I  Q  L  I  N  T  N  G
GGCGGAAACGCTGGCAGAACCACAAGCGGACTGGTCAGCCTCCTGACACCCGGAGCCAAACAGAATATCCAACTGATTAACACAAACGGA Gene       : HepC1a
Segment#   : 28
Offset     : 406
1st Codon  : 1
  T  P  G  A  K  Q  N  I  Q  L  I  N  T  N  G  S  W  H  I  N  S  T  A  L  N  C  N  E  S  L
ACCCCTGGCGCTAAGCAAAACATTCAGCTCATCAATACCAATGGCTCCTGGCATATCAATAGCACAGCCCTCAACTGTAACGAAAGCCTC Gene       : HepC1a
Segment#   : 29
Offset     : 421
1st Codon  : 1
  S  W  H  I  N  S  T  A  L  N  C  N  E  S  L  N  T  G  W  L  A  G  L  F  Y  Q  H  K  F  N
AGCTGGCACATTAACTCCACCGCTCTGAATTGCAATGAGTCCCTGAATACCGGATGGCTCGCCGGACTGTTTTACCAACACAAATTCAAT Gene       : HepC1a
Segment#   : 30
Offset     : 436
1st Codon  : 1
  N  T  G  W  L  A  G  L  F  Y  Q  H  K  F  N  S  S  G  C  P  E  R  L  A  S  C  R  R  L  T
AACACAGGCTGGCTGGCTGGCCTCTTCTATCAGCATAAGTTTAACTCCAGCGGATGCCCTGAGAGACTGGCTAGCTGTAGGAGACTGACA Gene       : HepC1a
Segment#   : 31
Offset     : 451
1st Codon  : 1
  S  S  G  C  P  E  R  L  A  S  C  R  R  L  T  D  F  D  Q  G  W  G  P  I  S  Y  A  N  G  S
AGCTCCGGCTGTCCCGAAAGGCTCGCCTCCTGCAGAAGGCTCACCGATTTCGATCAGGGATGGGGACCCATTAGCTATGCCAATGGCTCC Gene       : HepC1a
Segment#   : 32
Offset     : 466
1st Codon  : 1
  D  F  D  Q  G  W  G  P  I  S  Y  A  N  G  S  G  P  D  Q  R  P  Y  C  W  H  Y  P  P  K  P
GACTTTGACCAAGGCTGGGGCCCTATCTCCTACGCTAACGGAAGCGGACCCGATCAGAGACCCTATTGCTGGCACTATCCCCCTAAGCCT Gene       : HepC1a
Segment#   : 33
```

Figure 26 (Cont)

Offset : 481
1st Codon : 1
G P D Q R P Y C W H Y P P K P C G I V P A K S V C G P V Y C
GGCCCTGACCAAAGGCCTTACTGTTGGCATTACCCTCCCAAACCCTGTGGCATTGTGCCTGCCAAAAGCGTCTGCGGACCCGTCTACTGT Gene : HepC1a
Segment# : 34
Offset : 496
1st Codon : 1
C G I V P A K S V C G P V Y C F T P S P V V V G T T D R S G
TGCGGAATCGTCCCCGCTAAGTCCGTGTGTGGCCCTGTGTATTGCTTTACCCCTAGCCCTGTGGTCGTGGGAACCACAGACAGAAGCGGA Gene : HepC1a
Segment# : 35
Offset : 511
1st Codon : 1
F T P S P V V V G T T D R S G A P T Y S W G A N D T D V F V
TTCACACCCTCCCCCGTCGTGGTCGGCACAACCGATAGGTCCGGCGCTCCCACATACTCCTGGGGAGCCAATGACACAGACGTCTTCGTC Gene : HepC1a
Segment# : 36
Offset : 526
1st Codon : 1
A P T Y S W G A N D T D V F V L N N T R P P L G N W F G C T
GCCCCTACCTATAGCTGGGGCGCTAACGATACCGATGTGTTTGTGCTCAACAATACCAGACCCCCTCTGGGAAACTGGTTCGGATGCACA Gene : HepC1a
Segment# : 37
Offset : 541
1st Codon : 1
L N N T R P P L G N W F G C T W M N S T G F T K V C G A P P
CTGAATAACACAAGGCCTCCCCTCGGCAATTGGTTTGGCTGTACCTGGATGAATAGCACAGGCTTTACCAAAGTGTGTGGCGCTCCCCCT Gene : HepC1a
Segment# : 38
Offset : 556
1st Codon : 1
W M N S T G F T K V C G A P P C V I G G A G N N T L H C P T
TGGATGAACTCCACCGGATTCACAAAGGTCTGCGGAGCCCCTCCCTGTGTGATTGGCGGAGCCGGAAACAATACCCTCCACTGTCCCACA Gene : HepC1a
Segment# : 39
Offset : 571
1st Codon : 1
C V I G G A G N N T L H C P T D C F R K H P E A T Y S R C G
TGCGTCATCGGAGGCGCTGGCAATAACACACTGCATTGCCCTACCGATTGCTTTAGGAAACACCCTGAGGCTACCTATAGCAGATGCGGA Gene : HepC1a
Segment# : 40
Offset : 586
1st Codon : 1
D C F R K H P E A T Y S R C G S G P W I T P R C L V D Y P Y
GACTGTTTCAGAAAGCATCCCGAAGCCACATACTCCAGGTGTGGCTCCGGCCCTTGGATTACCCCTAGGTGTCTGGTCGACTATCCCTAT Gene : HepC1a
Segment# : 41
Offset : 601
1st Codon : 1
S G P W I T P R C L V D Y P Y R L W H Y P C T I N Y T I F K
AGCGGACCCTGGATCACACCCAGATGCCTCGTGGATTACCCTTACAGACTGTGGCACTATCCCTGTACCATTAACTATACCATTTTCAAA Gene : HepC1a
Segment# : 42
Offset : 616
1st Codon : 1
R L W H Y P C T I N Y T I F K V R M Y V G G V E H R L E A A
AGGCTCTGGCATTACCCTTGCACAATCAATTACACAATCTTTAAGGTCAGGATGTACGTCGGCGGAGTGGAACACAGACTGGAAGCCGCT Gene : HepC1a
Segment# : 43
Offset : 631
1st Codon : 1
V R M Y V G G V E H R L E A A C N W T R G E R C D L E D R D

Figure 26 (Cont)

GTGAGAATGTATGTGGGAGGCGTCGAGCATAGGCTCGAGGCTGCCTGTAACTGGACCAGAGGCGAAAGGTGTGACCTCGAGGATAGGGAT

```
Gene       : HepC1a
Segment#   : 44
Offset     : 646
1st Codon  : 1
  C  N  W  T  R  G  E  R  C  D  L  E  D  R  D  R  S  E  L  S  P  L  L  L  S  T  T  Q  W  Q
TGCAATTGGACAAGGGGAGAGAGATGCGATCTGGAAGACAGAGACAGAAGCGAACTGTCCCCCCTCCTGCTCAGCACAACCCAATGGCAA Gene       : HepC1a
Segment#   : 45
Offset     : 661
1st Codon  : 1
  R  S  E  L  S  P  L  L  L  S  T  T  Q  W  Q  V  L  P  C  S  F  T  T  L  P  A  L  S  T  G
AGGTCCGAGCTCAGCCCTCTGCTCCTGTCCACCACACAGTGGCAGGTCCTGCCTTGCTCCTTCACAACCCTCCCCGCTCTGTCCACCGGA Gene       : HepC1a
Segment#   : 46
Offset     : 676
1st Codon  : 1
  V  L  P  C  S  F  T  T  L  P  A  L  S  T  G  L  I  H  L  H  Q  N  I  V  D  V  Q  Y  L  Y
GTGCTCCCCTGTAGCTTTACCACACTGCCTGCCCTCAGCACAGGCCTCATCCATCTGCATCAGAATATCGTCGACGTCCAGTATCTGTAT Gene       : HepC1a
Segment#   : 47
Offset     : 691
1st Codon  : 1
  L  I  H  L  H  Q  N  I  V  D  V  Q  Y  L  Y  G  V  G  S  S  I  A  S  W  A  I  K  W  E  Y
CTGATTCACCTCCACCAAAACATTGTGGATGTGCAATACCTCTACGGAGTGGGAAGCTCCATCGCTAGCTGGGCCATTAAGTGGGAGTAT Gene       : HepC1a
Segment#   : 48
Offset     : 706
1st Codon  : 1
  G  V  G  S  S  I  A  S  W  A  I  K  W  E  Y  V  V  L  L  F  L  L  L  A  D  A  R  V  C  S
GGCGTCGGCTCCAGCATTGCCTCCTGGGCTATCAAATGGGAATACGTCGTGCTCCTGTTTCTGCTCCTGGCTGACGCTAGGGTCTGCTCC Gene       : HepC1a
Segment#   : 49
Offset     : 721
1st Codon  : 1
  V  V  L  L  F  L  L  L  A  D  A  R  V  C  S  C  L  W  M  M  L  L  I  S  Q  A  E  A  A  L
GTGGTCCTGCTCTTCCTCCTGCTCGCCGATGCCAGAGTGTGTAGCTGTCTGTGGATGATGCTGCTCATCTCCCAGGCTGAGGCTGCCCTC Gene       : HepC1a
Segment#   : 50
Offset     : 736
1st Codon  : 1
  C  L  W  M  M  L  L  I  S  Q  A  E  A  A  L  E  N  L  V  I  L  N  A  A  S  L  A  G  T  H
TGCCTCTGGATGATGCTCCTGATTAGCCAAGCCGAAGCCGCTCTGGAAAACCTCGTGATTCTGAATGCCGCTAGCCTCGCCGGAACCCAT Gene       : HepC1a
Segment#   : 51
Offset     : 751
1st Codon  : 1
  E  N  L  V  I  L  N  A  A  S  L  A  G  T  H  G  L  V  S  F  L  V  F  F  C  F  A  W  Y  L
GAGAATCTGGTCATCCTCAACGCTGCCTCCCTGGCTGGCACACACGGACTGGTCAGCTTTCTGGTCTTCTTTTGCTTTGCCTGGTACCTC Gene       : HepC1a
Segment#   : 52
Offset     : 766
1st Codon  : 1
  G  L  V  S  F  L  V  F  F  C  F  A  W  Y  L  K  G  R  W  V  P  G  A  V  Y  A  L  Y  G  M
GGCCTCGTGTCCTTCCTCGTGTTTTTCTGTTTCGCTTGGTATCTGAAAGGCAGATGGGTCCCCGGAGCCGTCTACGCTCTGTATGGCATG Gene       : HepC1a
Segment#   : 53
Offset     : 781
1st Codon  : 1
  K  G  R  W  V  P  G  A  V  Y  A  L  Y  G  M  W  P  L  L  L  L  L  L  A  L  P  Q  R  A  Y
AAGGGAAGGTGGGTGCCTGGCGCTGTGTATGCCCTCTACGGAATGTGGCCCCTCCTGCTCCTGCTCCTGGCTCTGCCCTCAGAGAGCCTAT Gene       : HepC1a
```

Figure 26 (Cont)

```
Segment#   : 54
Offset     : 796
1st Codon  : 1
 W  P  L  L  L  L  L  L  A  L  P  Q  R  A  Y  A  L  D  T  E  V  A  A  S  C  G  G  V  V  L
TGGCCTCTGCTCCTGCTCCTGCTCGCCCTCCCCCAAAGGGCTTACGCTCTGGATACCGAAGTGGCTGCCTCCTGCGGAGGCGTCGTGCTC Gene       : HepC1a
Segment#   : 55
Offset     : 811
1st Codon  : 1
 A  L  D  T  E  V  A  A  S  C  G  G  V  V  L  V  G  L  M  A  L  T  L  S  P  Y  Y  K  R  Y
GCCCTCGACACAGAGGTCGCCGCTAGCTGTGGCGGAGTGGTCCTGGTCGGCCTCATGGCTCTGACACTGTCCCCCTATTACAAAAGGTAT Gene       : HepC1a
Segment#   : 56
Offset     : 826
1st Codon  : 1
 V  G  L  M  A  L  T  L  S  P  Y  Y  K  R  Y  I  S  W  C  L  W  W  L  Q  Y  F  L  T  R  V
GTGGGACTGATGGCCCTCACCCTCAGCCCTTACTATAAGAGATACATTAGCTGGTGCCTCTGGTGGCTGCAATACTTTCTGACAAGGGTC Gene       : HepC1a
Segment#   : 57
Offset     : 841
1st Codon  : 1
 I  S  W  C  L  W  W  L  Q  Y  F  L  T  R  V  E  A  Q  L  H  V  W  V  P  P  L  N  V  R  G
ATCTCCTGGTGTCTGTGGTGGCTCCAGTATTTCCTCACCAGAGTGGAAGCCCAACTGCATGTGTGGGTGCCTCCCCTCAACGTCAGGGGA Gene       : HepC1a
Segment#   : 58
Offset     : 856
1st Codon  : 1
 E  A  Q  L  H  V  W  V  P  P  L  N  V  R  G  G  R  D  A  V  I  L  L  M  C  V  V  H  P  T
GAGGCTCAGCTCCACGTCTGGGTCCCCCCTCTGAATGTGAGAGGCGGAAGGGATGCCGTCATCCTCCTGATGTGCGTCGTGCATCCCACA Gene       : HepC1a
Segment#   : 59
Offset     : 871
1st Codon  : 1
 G  R  D  A  V  I  L  L  M  C  V  V  H  P  T  L  V  F  D  I  T  K  L  L  L  A  V  F  G  P
GGCAGAGACGCTGTGATTCTGCTCATGTGTGTGGTCCACCCTACCCTCGTGTTTGACATTACCAAACTGCTCCTGGCTGTGTTTGGCCCT Gene       : HepC1a
Segment#   : 60
Offset     : 886
1st Codon  : 1
 L  V  F  D  I  T  K  L  L  L  A  V  F  G  P  L  W  I  L  Q  A  S  L  L  K  V  P  Y  F  V
CTGGTCTTCGATATCACAAAGCTCCTGCTCGCCGTCTTCGGACCCCTCTGGATTCTGCAAGCCTCCCTGCTCAAGGTCCCCTATTTCGTC Gene       : HepC1a
Segment#   : 61
Offset     : 901
1st Codon  : 1
 L  W  I  L  Q  A  S  L  L  K  V  P  Y  F  V  R  V  Q  G  L  L  R  I  C  A  L  A  R  K  M
CTGTGGATCCTCCAGGCTAGCCTCCTGAAAGTGCCTTACTTTGTGAGAGTGCAAGGCCTCCTGAGAATCTGTGCCCTCGCCAGAAAGATG Gene       : HepC1a
Segment#   : 62
Offset     : 916
1st Codon  : 1
 R  V  Q  G  L  L  R  I  C  A  L  A  R  K  M  I  G  G  H  Y  V  Q  M  A  I  I  K  L  G  A
AGGGTCCAGGGACTGCTCAGGATTTGCGCTCTGGCTAGGAAAATGATTGGCGGACACTATGTGCAAATGGCTATCATTAAGCTCGGCGCT Gene       : HepC1a
Segment#   : 63
Offset     : 931
1st Codon  : 1
 I  G  G  H  Y  V  Q  M  A  I  I  K  L  G  A  L  T  G  T  Y  V  Y  N  H  L  T  P  L  R  D
ATCGGAGGCCATTACGTCCAGATGGCCATTATCAAACTGGGAGCCCTCACCGGAACCTATGTGTATAACCATCTGACACCCCTCAGGGAT Gene       : HepC1a
Segment#   : 64
Offset     : 946
1st Codon  : 1
```

Figure 26 (Cont)

L T G T Y V Y N H L T P L R D W A H N G L R D L A V A V E P
CTGACAGGCACATACGTCTACAATCACCTCACCCCTCTGAGAGACTGGGCCCATAACGGACTGAGAGACCTCGCCGTCGCCGTCGAGCCT

Gene : HepC1a
Segment# : 65
Offset : 961
1st Codon : 1
W A H N G L R D L A V A V E P V V F S Q M E T K L I T W G A
TGGGCTCACAATGGCCTCAGGGATCTGGCTGTGGCTGTGGAACCCGTCGTGTTTAGCCAAATGGAAACCAAACTGATTACCTGGGGCGCT Gene : HepC1a
Segment# : 66
Offset : 976
1st Codon : 1
V V F S Q M E T K L I T W G A D T A A C G D I I N G L P V S
GTGGTCTTCTCCCAGATGGAGACAAAGCTCATCACATGGGGAGCCGATACCGCTGCCTGTGGCGATATCATTAACGGACTGCCTGTGTCC Gene : HepC1a
Segment# : 67
Offset : 991
1st Codon : 1
D T A A C G D I I N G L P V S A R R G R E I L L G P A D G M
GACACAGCCGCTTGCGGAGACATTATCAATGGCCTCCCCGTCAGCGCTAGGAGAGGCAGAGAGATTCTGCTCGGCCCTGCCGATGGCATG Gene : HepC1a
Segment# : 68
Offset : 1006
1st Codon : 1
A R R G R E I L L G P A D G M V S K G W R L L A P I T A Y A
GCCAGAAGGGGAAGGGAAATCCTCCTGGGACCCGCTGACGGAATGGTCAGCAAAGGCTGGAGGCTCCTGGCTCCCATTACCGCTTACGCT Gene : HepC1a
Segment# : 69
Offset : 1021
1st Codon : 1
V S K G W R L L A P I T A Y A Q Q T R G L L G C I I T S L T
GTGTCCAAGGGATGGAGACTGCTCGCCCCTATCACAGCCTATGCCCAACAGACAAGGGGACTGCTCGGCTGTATCATTACCTCCCTGACA Gene : HepC1a
Segment# : 70
Offset : 1036
1st Codon : 1
Q Q T R G L L G C I I T S L T G R D K N Q V E G E V Q I V S
CAGCAAACCAGAGGCCTCCTGGGATGCATTATCACAAGCCTCACCGGAAGGGATAAGAATCAGGTCGAGGGAGAGGTCCAGATTGTGTCC Gene : HepC1a
Segment# : 71
Offset : 1051
1st Codon : 1
G R D K N Q V E G E V Q I V S T A A Q T F L A T C I N G V C
GGCAGAGACAAAAACCAAGTGGAAGGCGAAGTGCAAATCGTCAGCACAGCCGCTCAGACATTCCTCGCCACATGCATTAACGGAGTGTGT Gene : HepC1a
Segment# : 72
Offset : 1066
1st Codon : 1
T A A Q T F L A T C I N G V C W T V Y H G A G T R T I A S P
ACCGCTGCCCAAACCTTTCTGGCTACCTGTATCAATGGCGTCTGCTGGACCGTCTACCATGGCGCTGGCACAAGGACAATCGCTAGCCCT Gene : HepC1a
Segment# : 73
Offset : 1081
1st Codon : 1
W T V Y H G A G T R T I A S P K G P V I Q M Y T N V D Q D L
TGGACAGTGTATCACGGAGCCGGAACCAGAACCATTGCCTCCCCCAAAGGCCCTGTGATTCAGATGTACACAAACGTCGACCAAGACCTC Gene : HepC1a
Segment# : 74
Offset : 1096
1st Codon : 1
K G P V I Q M Y T N V D Q D L V G W P A P Q G S R S L T P C
AAGGGACCCGTCATCCAAATGTATACCAATGTGGATCAGGATCTGGTCGGCTGGCCCGCTCCCCAAGGCTCCAGGTCCCTGACACCCTGT

Figure 26 (Cont)

```
Gene      : HepC1a
Segment#  : 75
Offset    : 1111
1st Codon : 1
 V  G  W  P  A  P  Q  G  S  R  S  L  T  P  C  T  C  G  S  S  D  L  Y  L  V  T  R  H  A  D
GTGGGATGGCCTGCCCCTCAGGGAAGCAGAAGCCTCACCCCTTGCACATGCGGAAGCTCCGACCTCTACCTCGTGACAAGGCATGCCGAT Gene      : HepC1a
Segment#  : 76
Offset    : 1126
1st Codon : 1
 T  C  G  S  S  D  L  Y  L  V  T  R  H  A  D  V  I  P  V  R  R  R  G  D  S  R  G  S  L  L
ACCTGTGGCTCCAGCGATCTGTATCTGGTCACCAGACACGCTGACGTCATCCCTGTGAGAAGGAGAGGCGATAGCAGAGGCTCCCTGCTC Gene      : HepC1a
Segment#  : 77
Offset    : 1141
1st Codon : 1
 V  I  P  V  R  R  R  G  D  S  R  G  S  L  L  S  P  R  P  I  S  Y  L  K  G  S  S  G  G  P
GTGATTCCCGTCAGGAGAAGGGGAGACTCCAGGGGAAGCCTCCTGTCCCCAGACCCATTAGCTATCTGAAAGGCTCCAGCGGAGGCCCT Gene      : HepC1a
Segment#  : 78
Offset    : 1156
1st Codon : 1
 S  P  R  P  I  S  Y  L  K  G  S  S  G  G  P  L  L  C  P  A  G  H  A  V  G  I  F  R  A  A
AGCCCTAGGCCTATCTCCTACCTCAAGGGAAGCTCCGGCGGACCCCTCCTGTGTCCCGCTGGCCATGCCGTCGGCATTTTCAGAGCCGCT Gene      : HepC1a
Segment#  : 79
Offset    : 1171
1st Codon : 1
 L  L  C  P  A  G  H  A  V  G  I  F  R  A  A  V  C  T  R  G  V  A  K  A  V  D  F  I  P  V
CTGCTCTGCCCTGCCGGACACGCTGTGGGAATCTTTAGGGCTGCCGTCTGCACAAGGGGAGTGGCTAAGGCTGTGGATTTCATTCCCGTC Gene      : HepC1a
Segment#  : 80
Offset    : 1186
1st Codon : 1
 V  C  T  R  G  V  A  K  A  V  D  F  I  P  V  E  N  L  E  T  T  M  R  S  P  V  F  T  D  N
GTGTGTACCAGAGGCGTCGCCAAAGCCGTCGACTTTATCCCTGTGGAAAACCTCGAGACAACCATGAGGTCCCCCGTCTTCACAGACAAT Gene      : HepC1a
Segment#  : 81
Offset    : 1201
1st Codon : 1
 E  N  L  E  T  T  M  R  S  P  V  F  T  D  N  S  S  P  P  A  V  P  Q  S  F  Q  V  A  H  L
GAGAATCTGGAAACCACAATGAGAAGCCCTGTGTTTACCGATAACTCCAGCCCTCCCGCTGTGCCTCAGTCCTTCCAAGTGGCTCACCTC Gene      : HepC1a
Segment#  : 82
Offset    : 1216
1st Codon : 1
 S  S  P  P  A  V  P  Q  S  F  Q  V  A  H  L  H  A  P  T  G  S  G  K  S  T  K  V  P  A  A
AGCTCCCCCCCTGCCGTCCCCCAAAGCTTTCAGGTCGCCCATCTGCATGCCCCTACCGGAAGCGGAAAGTCCACCAAAGTGCCTGCCGCT Gene      : HepC1a
Segment#  : 83
Offset    : 1231
1st Codon : 1
 H  A  P  T  G  S  G  K  S  T  K  V  P  A  A  Y  A  A  Q  G  Y  K  V  L  V  L  N  P  S  V
CACGCTCCCACAGGCTCCGGCAAAAGCACAAAGGTCCCCGCTGCCTATGCCGCTCAGGGATACAAAGTGCTCGTGCTCAACCCTAGCGTC Gene      : HepC1a
Segment#  : 84
Offset    : 1246
1st Codon : 1
 Y  A  A  Q  G  Y  K  V  L  V  L  N  P  S  V  A  A  T  L  G  F  G  A  Y  M  S  K  A  H  G
TACGCTGCCCAAGGCTATAAGGTCCTGGTCCTGAATCCCTCCGTGGCTGCCACACTGGGATTCGGAGCCTATATGTCCAAGGCTCACGGA Gene      : HepC1a
Segment#  : 85
Offset    : 1261
```

Figure 26 (Cont)

```
1st Codon : 1
  A  A  T  L  G  F  G  A  Y  M  S  K  A  H  G  I  D  P  N  I  R  T  G  V  R  T  I  T  T  G
GCCGCTACCCTCGGCTTTGGCGCTTACATGAGCAAAGCCCATGGCATTGACCCTAACATTAGGACAGGCGTCAGGACAATCACAACCGGA Gene      : HepC1a
Segment#  : 86
Offset    : 1276
1st Codon : 1
  I  D  P  N  I  R  T  G  V  R  T  I  T  T  G  S  P  I  T  Y  S  T  Y  G  K  F  L  A  D  G
ATCGATCCCAATATCAGAACCGGAGTGAGAACCATTACCACAGGCTCCCCCATTACCTATAGCACATACGGAAAGTTTCTGGCTGACGGA Gene      : HepC1a
Segment#  : 87
Offset    : 1291
1st Codon : 1
  S  P  I  T  Y  S  T  Y  G  K  F  L  A  D  G  G  C  S  G  G  A  Y  D  I  I  I  C  D  E  C
AGCCCTATCACATACTCCACCTATGGCAAATTCCTCGCCGATGGCGGATGCTCCGGCGGAGCCTATGACATTATCATTTGCGATGAGTGT Gene      : HepC1a
Segment#  : 88
Offset    : 1306
1st Codon : 1
  G  C  S  G  G  A  Y  D  I  I  I  C  D  E  C  H  S  T  D  A  T  S  I  L  G  I  G  T  V  L
GGCTGTAGCGGAGGCGCTTACGATATCATTATCTGTGACGAATGCCATAGCACAGACGCTACCTCCATCCTCGGCATTGGCACAGTGCTC Gene      : HepC1a
Segment#  : 89
Offset    : 1321
1st Codon : 1
  H  S  T  D  A  T  S  I  L  G  I  G  T  V  L  D  Q  A  E  T  A  G  A  R  L  V  V  L  A  T
CACTCCACCGATGCCACAAGCATTCTGGGAATCGGAACCGTCCTGGATCAGGCTGAGACAGCCGGAGCCAGACTGGTCGTGCTCGCCACA Gene      : HepC1a
Segment#  : 90
Offset    : 1336
1st Codon : 1
  D  Q  A  E  T  A  G  A  R  L  V  V  L  A  T  A  T  P  P  G  S  V  T  V  P  H  P  N  I  E
GACCAAGCCGAAACCGCTGGCGCTAGGCTCGTGGTCCTGGCTACCGCTACCCCTCCCGGAAGCGTCACCGTCCCCCATCCCAATATCGAA Gene      : HepC1a
Segment#  : 91
Offset    : 1351
1st Codon : 1
  A  T  P  P  G  S  V  T  V  P  H  P  N  I  E  E  V  A  L  S  T  T  G  E  I  P  F  Y  G  K
GCCACACCCCCTGGCTCCGTGACAGTGCCTCACCCTAACATTGAGGAAGTGGCTCTGTCCACCACAGGCGAAATCCCTTTCTATGGCAAA Gene      : HepC1a
Segment#  : 92
Offset    : 1366
1st Codon : 1
  E  V  A  L  S  T  T  G  E  I  P  F  Y  G  K  A  I  P  L  E  V  I  K  G  G  R  H  L  I  F
GAGGTCGCCCTCAGCACAACCGGAGAGATTCCCTTTTACGGAAAGGCTATCCCTCTGGAAGTGATTAAGGGAGGCAGACACCTCATCTTT Gene      : HepC1a
Segment#  : 93
Offset    : 1381
1st Codon : 1
  A  I  P  L  E  V  I  K  G  G  R  H  L  I  F  C  H  S  K  K  K  C  D  E  L  A  A  K  L  V
GCCATTCCCCTCGAGGTCATCAAAGGCGGAAGGCATCTGATTTTCTGTCACTCCAAGAAAAAGTGTGACGAACTGGCTGCCAAACTGGTC Gene      : HepC1a
Segment#  : 94
Offset    : 1396
1st Codon : 1
  C  H  S  K  K  K  C  D  E  L  A  A  K  L  V  A  L  G  I  N  A  V  A  Y  Y  R  G  L  D  V
TGCCATAGCAAAAAGAAATGCGATGAGCTCGCCGCTAAGCTCGTGGCTCTGGGAATCAATGCCGTCGCCTATTACAGAGGCCTCGACGTC Gene      : HepC1a
Segment#  : 95
Offset    : 1411
1st Codon : 1
  A  L  G  I  N  A  V  A  Y  Y  R  G  L  D  V  S  V  I  P  T  S  G  D  V  V  V  V  A  T  D
GCCCTCGGCATTAACGCTGTGGCTTACTATAGGGGACTGGATGTGTCCGTGATTCCCACAAGCGGAGACGTCGTGGTCGTGGCTACCGAT
```

Figure 26 (Cont)

```
Gene      : HepC1a
Segment#  : 96
Offset    : 1426
1st Codon : 1
  S   V   I   P   T   S   G   D   V   V   V   V   A   T   D   A   L   M   T   G   Y   T   G   D   F   D   S   V   I   D
AGCGTCATCCCTACCTCCGGCGATGTGGTCGTGGTCGCCACAGACGCTCTGATGACCGGATACACAGGCGATTTCGATAGCGTCATCGAT Gene      : HepC1a
Segment#  : 97
Offset    : 1441
1st Codon : 1
  A   L   M   T   G   Y   T   G   D   F   D   S   V   I   D   C   N   T   C   V   T   Q   T   V   D   F   S   L   D   P
GCCCTCATGACAGGCTATACCGGAGACTTTGACTCCGTGATTGACTGTAACACATGCGTCACCCAAACCGTCGACTTTAGCCTCGACCCT Gene      : HepC1a
Segment#  : 98
Offset    : 1456
1st Codon : 1
  C   N   T   C   V   T   Q   T   V   D   F   S   L   D   P   T   F   T   I   E   T   T   T   L   P   Q   D   A   V   S
TGCAATACCTGTGTGACACAGACAGTGGATTTCTCCCTGGATCCCACATTCACAATCGAAACCACAACCCTCCCCCAAGACGCTGTGTCC Gene      : HepC1a
Segment#  : 99
Offset    : 1471
1st Codon : 1
  T   F   T   I   E   T   T   T   L   P   Q   D   A   V   S   R   T   Q   R   R   G   R   T   G   R   G   K   P   G   I
ACCTTTACCATTGAGACAACCACACTGCCTCAGGATGCCGTCAGCAGAACCCAAAGGAGAGGCAGAACCGGAAGGGGAAAGCCTGGCATT Gene      : HepC1a
Segment#  : 100
Offset    : 1486
1st Codon : 1
  R   T   Q   R   R   G   R   T   G   R   G   K   P   G   I   Y   R   F   V   A   P   G   E   R   P   S   G   M   F   D
AGGACACAGAGAAGGGGAAGGACAGGCAGAGGCAAACCCGGAATCTATAGGTTTGTGGCTCCCGGAGAGAGACCCTCCGGCATGTTCGAT Gene      : HepC1a
Segment#  : 101
Offset    : 1501
1st Codon : 1
  Y   R   F   V   A   P   G   E   R   P   S   G   M   F   D   S   S   V   L   C   E   C   Y   D   A   G   C   A   W   Y
TACAGATTCGTCGCCCCTGGCGAAAGGCCTAGCGGAATGTTTGACTCCAGCGTCCTGTGTGAGTGTTACGATGCCGGATGCGCTTGGTAT Gene      : HepC1a
Segment#  : 102
Offset    : 1516
1st Codon : 1
  S   S   V   L   C   E   C   Y   D   A   G   C   A   W   Y   E   L   T   P   A   E   T   T   V   R   L   R   A   Y   M
AGCTCCGTGCTCTGCGAATGCTATGACGCTGGCTGTGCCTGGTACGAACTGACACCCGCTGAGACAACCGTCAGGCTCAGGGCTTACATG Gene      : HepC1a
Segment#  : 103
Offset    : 1531
1st Codon : 1
  E   L   T   P   A   E   T   T   V   R   L   R   A   Y   M   N   T   P   G   L   P   V   C   Q   D   H   L   E   F   W
GAGCTCACCCCTGCCGAAACCACAGTGAGACTGAGAGCCTATATGAATACCCCTGGCCTCCCCGTCTGCCAAGACCATCTGGAATTCTGG Gene      : HepC1a
Segment#  : 104
Offset    : 1546
1st Codon : 1
  N   T   P   G   L   P   V   C   Q   D   H   L   E   F   W   E   G   V   F   T   G   L   T   H   I   D   A   H   F   L
AACACACCCGGACTGCCTGTGTGTCAGGATCACCTCGAGTTTTGGGAAGGCGTCTTCACAGGCCTCACCCATATCGATGCCCATTTCCTC Gene      : HepC1a
Segment#  : 105
Offset    : 1561
1st Codon : 1
  E   G   V   F   T   G   L   T   H   I   D   A   H   F   L   S   Q   T   K   Q   S   G   E   N   F   P   Y   L   V   A
GAGGGAGTGTTTACCGGACTGACACACATTGACGCTCACTTTCTGTCCCAGACAAAGCAAAGCGGAGAGAATTTCCCTTACCTCGTGGCT Gene      : HepC1a
Segment#  : 106
```

Figure 26 (Cont)

```
Offset       : 1576
1st Codon    : 1
  S   Q   T   K   Q   S   G   E   N   F   P   Y   L   V   A   Y   Q   A   T   V   C   A   R   A   Q   A   P   P   P   S
AGCCAAACCAAACAGTCCGGCGAAAACTTTCCCTATCTGGTCGCCTATCAGGCTACCGTCTGCGCTAGGGCTCAGGCTCCCCCTCCCTCC Gene         : HepCla
Segment#     : 107
Offset       : 1591
1st Codon    : 1
  Y   Q   A   T   V   C   A   R   A   Q   A   P   P   P   S   W   D   Q   M   W   K   C   L   I   R   L   K   P   T   L
TACCAAGCCACAGTGTGTGCCAGAGCCCAAGCCCCTCCCCCTAGCTGGGACCAAATGTGGAAGTGTCTGATTAGGCTCAAGCCTACCCTC Gene         : HepCla
Segment#     : 108
Offset       : 1606
1st Codon    : 1
  W   D   Q   M   W   K   C   L   I   R   L   K   P   T   L   H   G   P   T   P   L   L   Y   R   L   G   A   V   Q   N
TGGGATCAGATGTGGAAATGCCTCATCAGACTGAAACCCACACTGCATGGCCCTACCCCTCTGCTCTACAGACTGGGAGCCGTCCAGAAT Gene         : HepCla
Segment#     : 109
Offset       : 1621
1st Codon    : 1
  H   G   P   T   P   L   L   Y   R   L   G   A   V   Q   N   E   V   T   L   T   H   P   V   T   K   Y   I   M   T   C
CACGGACCCACACCCCTCCTGTATAGGCTCGGCGCTGTGCAAAACGAAGTGACACTGACACACCCTGTGACAAAGTATATCATGACCTGT Gene         : HepCla
Segment#     : 110
Offset       : 1636
1st Codon    : 1
  E   V   T   L   T   H   P   V   T   K   Y   I   M   T   C   M   S   A   D   L   E   V   V   T   S   T   W   V   L   V
GAGGTCACCCTCACCCATCCCGTCACCAAATACATTATGACATGCATGAGCGCTGACCTCGAGGTCGTGACAAGCACATGGGTCCTGGTC Gene         : HepCla
Segment#     : 111
Offset       : 1651
1st Codon    : 1
  M   S   A   D   L   E   V   V   T   S   T   W   V   L   V   G   G   V   L   A   A   L   A   A   Y   C   L   S   T   G
ATGTCCGCCGATCTGGAAGTGGTCACCTCCACCTGGGTGCTCGTGGGAGGCGTCCTGGCTGCCCTCGCCGCTTACTGTCTGTCCACCGGA Gene         : HepCla
Segment#     : 112
Offset       : 1666
1st Codon    : 1
  G   G   V   L   A   A   L   A   A   Y   C   L   S   T   G   C   V   V   I   V   G   R   I   V   L   S   G   K   P   A
GGCGGAGTGCTCGCCGCTCTGGCTGCCTATTGCCTCAGCACAGGCTGTGTGGTCATCGTCGGCAGAATCGTCCTGTCCGGCAAACCCGCT Gene         : HepCla
Segment#     : 113
Offset       : 1681
1st Codon    : 1
  C   V   V   I   V   G   R   I   V   L   S   G   K   P   A   I   I   P   D   R   E   V   L   Y   R   E   F   D   E   M
TGCGTCGTGATTGTGGGAAGGATTGTGCTCAGCGGAAAGCCTGCCATTATCCCTGACAGAGAGGTCCTGTATAGGGAATTCGATGAGATG Gene         : HepCla
Segment#     : 114
Offset       : 1696
1st Codon    : 1
  I   I   P   D   R   E   V   L   Y   R   E   F   D   E   M   E   E   C   S   Q   H   L   P   Y   I   E   Q   G   M   M
ATCATTCCCGATAGGGAAGTGCTCTACAGAGAGTTTGACGAAATGGAAGAGTGTAGCCAACACCTCCCCTATATCGAACAGGGAATGATG Gene         : HepCla
Segment#     : 115
Offset       : 1711
1st Codon    : 1
  E   E   C   S   Q   H   L   P   Y   I   E   Q   G   M   M   L   A   E   Q   F   K   Q   K   A   L   G   L   L   Q   T
GAGGAATGCTCCCAGCATCTGCCTTACATTGAGCAAGGCATGATGCTCGCCGAACAGTTTAAGCAAAAGGCTCTGGGACTGCTCCAGACA Gene         : HepCla
Segment#     : 116
Offset       : 1726
1st Codon    : 1
  L   A   E   Q   F   K   Q   K   A   L   G   L   L   Q   T   A   S   R   Q   A   E   V   I   A   P   A   V   Q   T   N
```

Figure 26 (Cont)

CTGGCTGAGCAATTCAAACAGAAAGCCCTCGGCCTCCTGCAAACCGCTAGCAGACAGGCTGAGGTCATCGCTCCCGCTGTGCAAACCAAT

Gene : HepC1a
Segment# : 117
Offset : 1741
1st Codon : 1
A S R Q A E V I A P A V Q T N W Q K L E V F W A K H M W N F
GCCTCCAGGCAAGCCGAAGTGATTGCCCCTGCCGTCCAGACAAACTGGCAGAAACTGGAAGTGTTTTGGGCTAAGCATATGTGGAACTTT Gene : HepC1a
Segment# : 118
Offset : 1756
1st Codon : 1
W Q K L E V F W A K H M W N F I S G I Q Y L A G L S T L P G
TGGCAAAAGCTCGAGGTCTTCTGGGCCAAACACATGTGGAATTTCATTAGCGGAATCCAATACCTCGCCGGACTGTCCACCCTCCCCGGA Gene : HepC1a
Segment# : 119
Offset : 1771
1st Codon : 1
I S G I Q Y L A G L S T L P G N P A I A S L M A F T A A V T
ATCTCCGGCATTCAGTATCTGGCTGGCCTCAGCACACTGCCTGGCAATCCCGCTATCGCTAGCCTCATGGCTTTCACAGCCGCTGTGACA Gene : HepC1a
Segment# : 120
Offset : 1786
1st Codon : 1
N P A I A S L M A F T A A V T S P L T T S Q T L L F N I L G
AACCCTGCCATTGCCTCCCTGATGGCCTTTACCGCTGCCGTCACCTCCCCCCTCACCACAAGCCAAACCCTCCTGTTTAACATTCTGGGA Gene : HepC1a
Segment# : 121
Offset : 1801
1st Codon : 1
S P L T T S Q T L L F N I L G G W V A A Q L A A P G A A T A
AGCCCTCTGACAACCTCCCAGACACTGCTCTTCAATATCCTCGGCGGATGGGTCGCCGCTCAGCTCGCCGCTCCCGGAGCCGCTACCGCT Gene : HepC1a
Segment# : 122
Offset : 1816
1st Codon : 1
G W V A A Q L A A P G A A T A F V G A G L A G A A I G S V G
GGCTGGGTGGCTGCCCAACTGGCTGCCCCTGGCGCTGCCACAGCCTTTGTGGGAGCCGGACTGGCTGGCGCTGCCATTGGCTCCGTGGGA Gene : HepC1a
Segment# : 123
Offset : 1831
1st Codon : 1
F V G A G L A G A A I G S V G L G K V L V D I L A G Y G A G
TTCGTCGGCGCTGGCCTCGCCGGAGCCGCTATCGGAAGCGTCGGCCTCGGCAAAGTGCTCGTGGATATCCTCGCCGGATACGGAGCCGGA Gene : HepC1a
Segment# : 124
Offset : 1846
1st Codon : 1
L G K V L V D I L A G Y G A G V A G A L V A F K I M S G E V
CTGGGAAAGGTCCTGGTCGACATTCTGGCTGGCTATGGCGCTGGCGTCGCCGGAGCCCTCGTGGCTTTCAAAATCATGAGCGGAGAGGTC Gene : HepC1a
Segment# : 125
Offset : 1861
1st Codon : 1
V A G A L V A F K I M S G E V P S T E D L V N L L P A I L S
GTGGCTGGCGCTCTGGTCGCCTTTAAGATTATGTCCGGCGAAGTGCCTAGCACAGAGGATCTGGTCAACCTCCTGCCTGCCATTCTGTCC Gene : HepC1a
Segment# : 126
Offset : 1876
1st Codon : 1
P S T E D L V N L L P A I L S P G A L V V G V V C A A I L R
CCCTCCACCGAAGACCTCGTGAATCTGCTCCCCGCTATCCTCAGCCCTGGCGCTCTGGTCGTGGGAGTGGTCTGCGCTGCCATTCTGAGA Gene : HepC1a

Figure 26 (Cont)

```
Segment#  : 127
Offset    : 1891
1st Codon : 1
  P   G   A   L   V   V   G   V   V   C   A   A   I   L   R   R   H   V   G   P   G   E   G   A   V   Q   W   M   N   R
CCCGGAGCCCTCGTGGTCGGCGTCGTGTGTGCCGCTATCCTCAGGAGACACGTCGGCCCTGGCGAAGGCGCTGTGCAATGGATGAACAGA Gene      : HepC1a
Segment#  : 128
Offset    : 1906
1st Codon : 1
  R   H   V   G   P   G   E   G   A   V   Q   W   M   N   R   L   I   A   F   A   S   R   G   N   H   V   S   P   T   H
AGGCATGTGGGACCCGGAGAGG V K N G T M R I V G P R T C R N M W S G T F P I N A Y T T G
GTGAAAAACGGAACCATGAGGATTGTGGGACCCAGAACCTGTAGGAATATGTGGAGCGGAACCTTTCCCATTAACGCTTACACAACCGGA Gene : HepC1a
Segment# : 138
Offset : 2056
1st Codon : 1
N M W S G T F P I N A Y T T G P C T P L P A P N Y T F A L W
AACATGTGGTCCGGCACATTCCCTATCAATGCCTATACCACAGGCCCTTGCACACCCCTCCCCGCTCCCAATTACACATTCGCTCTGTGG Gene : HepC1a
Segment# : 139
Offset : 2071
1st Codon : 1
P C T P L P A P N Y T F A L W R V S A E E Y V E I R R V G D
CCCTGTACCCCTCTGCCTGCCCCTAACTATACCTTTGCCCTCTGGAGAGTGTCCGCCGAAGAGTATGTGGAAATCAGAAGGGTCGGCGAT Gene : HepC1a
Segment# : 140
Offset : 2086
1st Codon : 1
R V S A E E Y V E I R R V G D F H Y V T G M T T D N L K C P
AGGGTCAGCGCTGAGGAATACGTCGAGATTAGGAGAGTGGGAGACTTTCACTATGTGACAGGCATGACCACAGACAATCTGAAATGCCCT Gene : HepC1a
Segment# : 141
Offset : 2101
1st Codon : 1
F H Y V T G M T T D N L K C P C Q V P S P E F F T E L D G V
TTCCATTACGTCACCGGAATGACAACCGATAACCTCAAGTGTCCCTGTCAGGTCCCCTCCCCCGAATTCTTTACCGAACTGGATGGCGTC Gene : HepC1a
Segment# : 142
Offset : 2116
1st Codon : 1
C Q V P S P E F F T E L D G V R L H R F A P P C K P L L R E
TGCCAAGTGCCTAGCCCTGAGTTTTTCACAGAGCTCGACGGAGTGAGACTGCATAGGTTTGCCCCTCCCTGTAAGCCTCTGCTCAGGGAA Gene : HepC1a
Segment# : 143
Offset : 2131
1st Codon : 1
R L H R F A P P C K P L L R E E V S F R V G L H E Y P V G S
AGGCTCCACAGATTCGCTCCCCCTTGCAAACCCCTCCTGAGAGAGGAAGTGTCCTTCAGAGTGGGACTGCATGAGTATCCCGTCGGCTCC Gene : HepC1a
Segment# : 144
Offset : 2146
1st Codon : 1
E V S F R V G L H E Y P V G S Q L P C E P E P D V A V L T S
GAGGTCAGCTTTAGGGTCGGCCTCCACGAATACCCTGTGGGAAGCCAACTGCCTTGCGAACCCGAACCCGATGTGGCTGTGCTCACCTCC Gene : HepC1a
Segment# : 145
Offset : 2161
1st Codon : 1
Q L P C E P E P D V A V L T S M L T D P S H I T A E A A G R
CAGCTCCCCTGTGAGCCTGAGCCTGACGTCGCCGTCCTGACAAGCATGCTGACAGACCCTAGCCATATCACAGCCGAAGCCGCTGGCAGA Gene : HepC1a
Segment# : 146
Offset : 2176
1st Codon : 1
M L T D P S H I T A E A A G R R L A R G S P P S M A S S S A
ATGCTCACCGATCCCTCCCACATTACCGCTGAGGCTGCCGGAAGGAGACTGGCTAGGGGAAGCCCTCCCTCCATGGCTAGCTCCAGCGCT Gene : HepC1a
Segment# : 147
Offset : 2191
1st Codon : 1
R L A R G S P P S M A S S S A S Q L S A P S L K A T C T A N
AGGCTCGCCAGAGGCTCCCCCCCTAGCATGGCCTCCAGCTCCGCCTCCCAGCTCAGCGCTCCCTCCCTGAAAGCCACATGCACAGCCAAT

Figure 26 (Cont)

```
Gene       : HepC1a
Segment#   : 148
Offset     : 2206
1st Codon  : 1
  S  Q  L  S  A  P  S  L  K  A  T  C  T  A  N  H  D  S  P  D  A  E  L  I  E  A  N  L  L  W
AGCCAACTGTCCGCCCCTAGCCTCAAGGCTACCTGTACCGCTAACCATGACTCCCCCGATGCCGAACTGATTGAGGCTAACCTCCTGTGG Gene       : HepC1a
Segment#   : 149
Offset     : 2221
1st Codon  : 1
  H  D  S  P  D  A  E  L  I  E  A  N  L  L  W  R  Q  E  M  G  G  N  I  T  R  V  E  S  E  N
CACGATAGCCCTGACGCTGAGCTCATCGAAGCCAATCTGCTCTGGAGACAGGAAATGGGAGGCAATATCACAAGGGTCGAGTCCGAGAAT Gene       : HepC1a
Segment#   : 150
Offset     : 2236
1st Codon  : 1
  R  Q  E  M  G  G  N  I  T  R  V  E  S  E  N  K  V  V  I  L  D  S  F  D  P  L  V  A  E  E
AGGCAAGAGATGGGCGGAAACATTACCAGAGTGGAAAGCGAAAACAAAGTGGTCATCCTCGACTCCTTCGATCCCCTCGTGGCTGAGGAA Gene       : HepC1a
Segment#   : 151
Offset     : 2251
1st Codon  : 1
  K  V  V  I  L  D  S  F  D  P  L  V  A  E  E  D  E  R  E  I  S  V  P  A  E  I  L  R  K  S
AAGGTCGTGATTCTGGATAGCTTTGACCCTCTGGTCGCCGAAGAGGATGAGAGAGAGATTAGCGTCCCCGCTGAGATTCTGAGAAAGTCC Gene       : HepC1a
Segment#   : 152
Offset     : 2266
1st Codon  : 1
  D  E  R  E  I  S  V  P  A  E  I  L  R  K  S  R  R  F  A  Q  A  L  P  V  W  A  R  P  D  Y
GACGAAAGGGAAATCTCCGTGCCTGCCGAAATCCTCAGGAAAAGCAGAAGGTTTGCCCAAGCCCTCCCCGTCTGGGCTAGGCCTGACTAT Gene       : HepC1a
Segment#   : 153
Offset     : 2281
1st Codon  : 1
  R  R  F  A  Q  A  L  P  V  W  A  R  P  D  Y  N  P  P  L  V  E  T  W  K  K  P  D  Y  E  P
AGGAGATTCGCTCAGGCTCTGCCTGTGTGGGCCAGACCCGATTACAATCCCCCTCTGGTCGAGACATGGAAAAAGCCTGACTATGAGCCT Gene       : HepC1a
Segment#   : 154
Offset     : 2296
1st Codon  : 1
  N  P  P  L  V  E  T  W  K  K  P  D  Y  E  P  P  V  V  H  G  C  P  L  P  P  P  R  S  P  P
AACCCTCCCCTCGTGGAAACCTGGAAGAAACCCGATTACGAACCCCCTGTGGTCCACGGATGCCCTCTGCCTCCCCCTAGGTCCCCCCCT Gene       : HepC1a
Segment#   : 155
Offset     : 2311
1st Codon  : 1
  P  V  V  H  G  C  P  L  P  P  P  R  S  P  P  V  P  P  P  R  K  K  R  T  V  V  L  T  E  S
CCCGTCGTGCATGGCTGTCCCCTCCCCCCTCCCAGAAGCCCTCCCGTCCCCCCTCCCAGAAAGAAAAGGACAGTGGTCCTGACAGAGTCC Gene       : HepC1a
Segment#   : 156
Offset     : 2326
1st Codon  : 1
  V  P  P  P  R  K  K  R  T  V  V  L  T  E  S  T  L  S  T  A  L  A  E  L  A  T  K  S  F  G
GTGCCTCCCCCTAGGAAAAAGAGAACCGTCGTGCTCACCGAAAGCACACTGTCCACCGCTCTGGCTGAGCTCGCCACAAAGTCCTTCGGA Gene       : HepC1a
Segment#   : 157
Offset     : 2341
1st Codon  : 1
  T  L  S  T  A  L  A  E  L  A  T  K  S  F  G  S  S  S  T  S  G  I  T  G  D  N  T  T  T  S
ACCCTCAGCACAGCCCTCGCCGAACTGGCTACCAAAAGCTTTGGCTCCAGCTCCACCTCCGGCATTACCGGAGACAATACCACAACCTCC Gene       : HepC1a
Segment#   : 158
Offset     : 2356
```

Figure 26 (Cont)

```
1st Codon : 1
    S  S  S  T  S  G  I  T  G  D  N  T  T  T  S  S  E  P  A  P  S  G  C  P  P  D  S  D  A  E
AGCTCCAGCACAAGCGGAATCACAGGCGATAACACAACCACAAGCTCCGAGCCTGCCCCTAGCGGATGCCCTCCCGATAGCGATGCCGAA Gene      : HepC1a
Segment#  : 159
Offset    : 2371
1st Codon : 1
    S  E  P  A  P  S  G  C  P  P  D  S  D  A  E  S  Y  S  S  M  P  P  L  E  G  E  P  G  D  P
AGCGAACCCGCTCCCTCCGGCTGTCCCCCTGACTCCGACGCTGAGTCCTACTCCAGCATGCCCCCTCTGGAAGGCGAACCCGGAGACCCT Gene      : HepC1a
Segment#  : 160
Offset    : 2386
1st Codon : 1
    S  Y  S  S  M  P  P  L  E  G  E  P  G  D  P  D  L  S  D  G  S  W  S  T  V  S  S  E  A  G
AGCTATAGCTCCATGCCTCCCCTCGAGGGAGAGCCTGGCGATCCCGATCTGTCCGACGGAAGCTGGAGCACAGTGTCCAGCGAAGCCGGA Gene      : HepC1a
Segment#  : 161
Offset    : 2401
1st Codon : 1
    D  L  S  D  G  S  W  S  T  V  S  S  E  A  G  T  E  D  V  V  C  C  S  M  S  Y  S  W  T  G
GACCTCAGCGATGGCTCCTGGTCCACCGTCAGCTCCGAGGCTGGCACAGAGGATGTGGTCTGCTGTAGCATGAGCTATAGCTGGACCGGA Gene      : HepC1a
Segment#  : 162
Offset    : 2416
1st Codon : 1
    T  E  D  V  V  C  C  S  M  S  Y  S  W  T  G  A  L  V  T  P  C  A  A  E  E  Q  K  L  P  I
ACCGAAGACGTCGTGTGTTGCTCCATGTCCTACTCCTGGACAGGCGCTCTGGTCACCCCTTGCGCTGCCGAAGAGCAAAAGCTCCCCATT Gene      : HepC1a
Segment#  : 163
Offset    : 2431
1st Codon : 1
    A  L  V  T  P  C  A  A  E  E  Q  K  L  P  I  N  A  L  S  N  S  L  L  R  H  H  N  L  V  Y
GCCCTCGTGACACCCTGTGCCGCTGAGGAACAGAAACTGCCTATCAATGCCCTCAGCAATAGCCTCCTGAGACACCATAACCTCGTGTAT Gene      : HepC1a
Segment#  : 164
Offset    : 2446
1st Codon : 1
    N  A  L  S  N  S  L  L  R  H  H  N  L  V  Y  S  T  T  S  R  S  A  C  Q  R  Q  K  K  V  T
AACGCTCTGTCCAACTCCCTGCTCAGGCATCACAATCTGGTCTACTCCACCACAAGCAGAAGCGCTTGCCAAAGGCAAAAGAAAGTGACA Gene      : HepC1a
Segment#  : 165
Offset    : 2461
1st Codon : 1
    S  T  T  S  R  S  A  C  Q  R  Q  K  K  V  T  F  D  R  L  Q  V  L  D  S  H  Y  Q  D  V  L
AGCACAACCTCCAGGTCCGCCTGTCAGAGACAGAAAAAGGTCACCTTTGACAGACTGCAAGTGCTCGACTCCCACTATCAGGATGTGCTC Gene      : HepC1a
Segment#  : 166
Offset    : 2476
1st Codon : 1
    F  D  R  L  Q  V  L  D  S  H  Y  Q  D  V  L  K  E  V  K  A  A  A  S  K  V  K  A  N  L  L
TTCGATAGGCTCCAGGTCCTGGATAGCCATTACCAAGACGTCCTGAAAGAGGTCAAGGCTGCCGCTAGCAAAGTGAAAGCCAATCTGCTC Gene      : HepC1a
Segment#  : 167
Offset    : 2491
1st Codon : 1
    K  E  V  K  A  A  A  S  K  V  K  A  N  L  L  S  V  E  E  A  C  S  L  T  P  P  H  S  A  K
AAGGAAGTGAAAGCCGCTGCCTCCAAGGTCAAGGCTAACCTCCTGTCCGTGGAAGAGGCTTGCTCCCTGACACCCCCTCACTCCGCCAAA Gene      : HepC1a
Segment#  : 168
Offset    : 2506
1st Codon : 1
    S  V  E  E  A  C  S  L  T  P  P  H  S  A  K  S  K  F  G  Y  G  A  K  D  V  R  C  H  A  R
AGCGTCGAGGAAGCCTGTAGCCTCACCCCTCCCCATAGCGCTAAGTCCAAGTTTGGCTATGGCGCTAAGGATGTGAGATGCCATGCCAGA
```

Figure 26 (Cont)

```
Gene       : HepC1a
Segment#   : 169
Offset     : 2521
1st Codon  : 1
  S  K  F  G  Y  G  A  K  D  V  R  C  H  A  R  K  A  V  A  H  I  N  S  V  W  K  D  L  L  E
AGCAAATTCGGATACGGAGCCAAAGACGTCAGGTGTCACGCTAGGAAAGCCGTCGCCCATATCAATAGCGTCTGGAAAGACCTCCTGGAA Gene       : HepC1a
Segment#   : 170
Offset     : 2536
1st Codon  : 1
  K  A  V  A  H  I  N  S  V  W  K  D  L  L  E  D  S  V  T  P  I  D  T  T  I  M  A  K  N  E
AAGGCTGTGGCTCACATTAACTCCGTGTGGAAGGATCTGCTCGAGGATAGCGTCACCCCTATCGATACCACAATCATGGCCAAAAACGAA Gene       : HepC1a
Segment#   : 171
Offset     : 2551
1st Codon  : 1
  D  S  V  T  P  I  D  T  T  I  M  A  K  N  E  V  F  C  V  Q  P  E  K  G  G  R  K  P  A  R
GACTCCGTGACACCCATTGACACAACCATTATGGCTAAGAATGAGGTCTTCTGTGTGCAACCCGAAAAGGGAGGCAGAAAGCCTGCCAGA Gene       : HepC1a
Segment#   : 172
Offset     : 2566
1st Codon  : 1
  V  F  C  V  Q  P  E  K  G  G  R  K  P  A  R  L  I  V  F  P  D  L  G  V  R  V  C  E  K  M
GTGTTTTGCGTCCAGCCTGAGAAAGGCGGAAGGAAACCCGCTAGGCTCATCGTCTTCCCTGACCTCGGCGTCAGGGTCTGCGAAAAGATG Gene       : HepC1a
Segment#   : 173
Offset     : 2581
1st Codon  : 1
  L  I  V  F  P  D  L  G  V  R  V  C  E  K  M  A  L  Y  D  V  V  S  K  L  P  L  A  V  M  G
CTGATTGTGTTTCCCGATCTGGGAGTGAGAGTGTGTGAGAAAATGGCTCTGTATGACGTCGTGTCCAAGCTCCCCCTCGCCGTCATGGGA Gene       : HepC1a
Segment#   : 174
Offset     : 2596
1st Codon  : 1
  A  L  Y  D  V  V  S  K  L  P  L  A  V  M  G  S  S  Y  G  F  Q  Y  S  P  G  Q  R  V  E  F
GCCCTCTACGATGTGGTCAGCAAACTGCCTCTGGCTGTGATGGGCTCCAGCTATGGCTTTCAGTATAGCCCTGGCCAAAGGGTCGAGTTT Gene       : HepC1a
Segment#   : 175
Offset     : 2611
1st Codon  : 1
  S  S  Y  G  F  Q  Y  S  P  G  Q  R  V  E  F  L  V  Q  A  W  K  S  K  K  T  P  M  G  F  S
AGCTCCTACGGATTCCAATACTCCCCCGGACAGAGAGTGGAATTCCTCGTGCAAGCCTGGAAGTCCAAGAAAACCCCTATGGGATTCTCC Gene       : HepC1a
Segment#   : 176
Offset     : 2626
1st Codon  : 1
  L  V  Q  A  W  K  S  K  K  T  P  M  G  F  S  Y  D  T  R  C  F  D  S  T  V  T  E  S  D  I
CTGGTCCAGGCTTGGAAAAGCAAAAAGACACCCATGGGCTTTAGCTATGACACAAGGTGTTTCGATAGCACAGTGACAGAGTCCGACATT Gene       : HepC1a
Segment#   : 177
Offset     : 2641
1st Codon  : 1
  Y  D  T  R  C  F  D  S  T  V  T  E  S  D  I  R  T  E  E  A  I  Y  Q  C  C  D  L  D  P  Q
TACGATACCAGATGCTTTGACTCCACCGTCACCGAAAGCGATATCAGAACCGAAGAGGCTATCTATCAGTGTTGCGATCTGGATCCCCAA Gene       : HepC1a
Segment#   : 178
Offset     : 2656
1st Codon  : 1
  R  T  E  E  A  I  Y  Q  C  C  D  L  D  P  Q  A  R  V  A  I  K  S  L  T  E  R  L  Y  V  G
AGGACAGAGGAAGCCATTTACCAATGCTGTGACCTCGACCCTCAGGCTAGGGTCGCCATTAAGTCCCTGACAGAGAGACTGTATGTGGGA Gene       : HepC1a
Segment#   : 179
```

Offset : 2671
1st Codon : 1
A R V A I K S L T E R L Y V G G P L T N S R G E N C G Y R R
GCCAGAGTGGCTATCAAAAGCCTCACCGAAAGGCTCTACGTCGGCGGACCCCTCACCAATAGCAGAGGCGAAAACTGTGGCTATAGGAGA Gene : HepC1a
Segment# : 180
Offset : 2686
1st Codon : 1
G P L T N S R G E N C G Y R R C R A S G V L T T S C G N T L
GGCCCTCTGACAAACTCCAGGGGAGAGAATTGCGGATACAGAAGGTGTAGGGCTAGCGGAGTGCTCACCACAAGCTGTGGCAATACCCTC Gene : HepC1a
Segment# : 181
Offset : 2701
1st Codon : 1
C R A S G V L T T S C G N T L T C Y I K A R A A C R A A G L
TGCAGAGCCTCCGGCGTCCTGACAACCTCCTGCGGAAACACACTGACATGCTATATCAAAGCCAGAGCCGCTTGCAGAGCCGCTGGCCTC Gene : HepC1a
Segment# : 182
Offset : 2716
1st Codon : 1
T C Y I K A R A A C R A A G L Q D C T M L V C G D D L V V I
ACCTGTTACATTAAGGCTAGGGCTGCCTGTAGGGCTGCCGGACTGCAAGACTGTACCATGCTGGTCTGCGGAGACGATCTGGTCGTGATT Gene : HepC1a
Segment# : 183
Offset : 2731
1st Codon : 1
Q D C T M L V C G D D L V V I C E S A G V Q E D A A S L R A
CAGGATTGCACAATGCTCGTGTGTGGCGATGACCTCGTGGTCATCTGTGAGTCCGCCGGAGTGCAAGAGGATGCCGCTAGCCTCAGGGCT Gene : HepC1a
Segment# : 184
Offset : 2746
1st Codon : 1
C E S A G V Q E D A A S L R A F T E A M T R Y S A P P G D P
TGCGAAAGCGCTGGCGTCCAGGAAGACGCTGCCTCCCTGAGAGCCTTTACCGAAGCCATGACCAGATACTCCGCCCCTCCCGGAGACCCT Gene : HepC1a
Segment# : 185
Offset : 2761
1st Codon : 1
F T E A M T R Y S A P P G D P P Q P E Y D L E L I T S C S S
TTCACAGAGGCTATGACAAGGTATAGCGCTCCCCCTGGCGATCCCCCTCAGCCTGAGTATGACCTCGAGCTCATCACAAGCTGTAGCTCC Gene : HepC1a
Segment# : 186
Offset : 2776
1st Codon : 1
P Q P E Y D L E L I T S C S S N V S V A H D G A G K R V Y Y
CCCCAACCCGAATACGATCTGGAACTGATTACCTCCTGCTCCAGCAATGTGTCCGTGGCTCACGATGGCGCTGGCAAAAGGGTCTACTAT Gene : HepC1a
Segment# : 187
Offset : 2791
1st Codon : 1
N V S V A H D G A G K R V Y Y L T R D P T T P L A R A A W E
AACGTCAGCGTCGCCCATGACGGAGCCGGAAAGAGAGTGTATTACCTCACCAGAGACCCTACCACACCCCTCGCCAGAGCCGCTTGGGAA Gene : HepC1a
Segment# : 188
Offset : 2806
1st Codon : 1
L T R D P T T P L A R A A W E T A R H T P V N S W L G N I I
CTGACAAGGGATCCCACAACCCCTCTGGCTAGGGCTGCCTGGGAGACAGCCAGACACACACCCGTCAACTCCTGGCTCGGCAATATCATT Gene : HepC1a
Segment# : 189
Offset : 2821
1st Codon : 1
T A R H T P V N S W L G N I I M F A P T L W A R M I L M T H

Figure 26 (Cont)

```
ACCGCTAGGCATACCCCTGTGAATAGCTGGCTGGGAAACATTATCATGTTCGCTCCCACACTGTGGGCCAGAATGATTCTGATGACCCAT

Gene     : HepC1a
Segment# : 190
Offset   : 2836
1st Codon : 1
 M  F  A  P  T  L  W  A  R  M  I  L  M  T  H  F  F  S  V  L  I  A  R  D  Q  L  E  Q  A  L
ATGTTTGCCCCTACCCTCTGGGCTAGGATGATCCTCATGACACACTTTTTCTCCGTGCTCATCGCTAGGGATCAGCTCGAGCAAGCCCTC Gene     : HepC1a
Segment# : 191
Offset   : 2851
1st Codon : 1
 F  F  S  V  L  I  A  R  D  Q  L  E  Q  A  L  D  C  E  I  Y  G  A  C  Y  S  I  E  P  L  D
TTCTTTAGCGTCCTGATTGCCAGAGACCAACTGGAACAGGCTCTGGATTGCGAAATCTATGGCGCTTGCTATAGCATTGAGCCTCTGGAT Gene     : HepC1a
Segment# : 192
Offset   : 2866
1st Codon : 1
 D  C  E  I  Y  G  A  C  Y  S  I  E  P  L  D  L  P  P  I  I  Q  R  L  H  G  L  S  A  F  S
GACTGTGAGATTTACGGAGCCTGTTACTCCATCGAACCCCTCGACCTCCCCCCTATCATTCAGAGACTGCATGGCCTCAGCGCTTTCTCC Gene     : HepC1a
Segment# : 193
Offset   : 2881
1st Codon : 1
 L  P  P  I  I  Q  R  L  H  G  L  S  A  F  S  L  H  S  Y  S  P  G  E  I  N  R  V  A  A  C
CTGCCTCCCATTATCCAAAGGCTCCACGGACTGTCCGCCTTTAGCCTCCACTCCTACTCCCCCGGAGAGATTAACAGAGTGGCTGCCTGT Gene     : HepC1a
Segment# : 194
Offset   : 2896
1st Codon : 1
 L  H  S  Y  S  P  G  E  I  N  R  V  A  A  C  L  R  K  L  G  V  P  P  L  R  A  W  R  H  R
CTGCATAGCTATAGCCCTGGCGAAATCAATAGGGTCGCCGCTTGCCTCAGGAAACTGGGAGTGCCTCCCCTCAGGGCTTGGAGACACAGA Gene     : HepC1a
Segment# : 195
Offset   : 2911
1st Codon : 1
 L  R  K  L  G  V  P  P  L  R  A  W  R  H  R  A  R  S  V  R  A  R  L  L  A  R  G  G  R  A
CTGAGAAAGCTCGGCGTCCCCCCTCTGAGAGCCTGGAGGCATAGGGCTAGGTCCGTGAGAGCCAGACTGCTCGCCAGAGGCGGAAGGGCT Gene     : HepC1a
Segment# : 196
Offset   : 2926
1st Codon : 1
 A  R  S  V  R  A  R  L  L  A  R  G  G  R  A  A  I  C  G  K  Y  L  F  N  W  A  V  R  T  K
GCCAGAAGCGTCAGGGCTAGGCTCCTGGCTAGGGGAGGCAGAGCCGCTATCTGTGGCAAATACCTCTTCAATTGGGCTGTGAGAACCAAA Gene     : HepC1a
Segment# : 197
Offset   : 2941
1st Codon : 1
 A  I  C  G  K  Y  L  F  N  W  A  V  R  T  K  L  K  L  T  P  I  A  A  A  G  R  L  D  L  S
GCCATTTGCGGAAAGTATCTGTTTAACTGGGCCGTCAGGACAAAGCTCAAGCTCACCCCTATCGCTGCCGCTGGCAGACTGGATCTGTCC Gene     : HepC1a
Segment# : 198
Offset   : 2956
1st Codon : 1
 L  K  L  T  P  I  A  A  A  G  R  L  D  L  S  G  W  F  T  A  G  Y  S  G  G  D  I  Y  H  S
CTGAAACTGACACCCATTGCCGCTGCCGGAAGGCTCGACCTCAGCGGATGGTTTACCGCTGGCTATAGCGGAGGCGATATCTATCACTCC Gene     : HepC1a
Segment# : 199
Offset   : 2971
1st Codon : 1
 G  W  F  T  A  G  Y  S  G  G  D  I  Y  H  S  V  S  H  A  R  P  R  W  F  W  F  C  L  L  L
GGCTGGTTCACAGCCGGATACTCCGGCGGAGACATTTACCATAGCGTCAGCCATGCCAGACCCAGATGGTTTTGGTTTTGCCTCCTGCTC Gene     : HepC1a
```

Figure 26 (Cont)

```
Segment#   : 200
Offset     : 2986
1st Codon  : 1
    V  S  H  A  R  P  R  W  F  W  F  C  L  L  L  L  A  A  G  V  G  I  Y  L  L  P  N  R  A  A
GTGTCCCACGCTAGGCCTAGGTGGTTCTGGTTCTGTCTGCTCCTGCTCGCCGCTGGCGTCGGCATTTACCTCCTGCCTAACAGAGCCGCT Gene       : HepC1a
Segment#   : 201
Offset     : 3001
1st Codon  : 1
    L  A  A  G  V  G  I  Y  L  L  P  N  R  A  A
CTGGCTGCCGGAGTGGGAATCTATCTGCTCCCCAATAGGGCTGCC Segments in scrambled order:
----------------------------
HepC1a #77
    V  I  P  V  R  R  R  G  D  S  R  G  S  L  L  S  P  R  P  I  S  Y  L  K  G  S  S  G  G  P
GTGATTCCCGTCAGGAGAAGGGGAGACTCCAGGGGAAGCCTCCTGTCCCCCAGACCCATTAGCTATCTGAAAGGCTCCAGCGGAGGCCCT HepC1a #68
    A  R  R  G  R  E  I  L  L  G  P  A  D  G  M  V  S  K  G  W  R  L  L  A  P  I  T  A  Y  A
GCCAGAAGGGGAAGGGAAATCCTCCTGGGACCCGCTGACGGAATGGTCAGCAAAGGCTGGAGGCTCCTGGCTCCCATTACCGCTTACGCT HepC1a #143
    R  L  H  R  F  A  P  P  C  K  P  L  L  R  E  E  V  S  F  R  V  G  L  H  E  Y  P  V  G  S
AGGCTCCACAGATTCGCTCCCCCCTTGCAAACCCCTCCTGAGAGAGGAAGTGTCCTTCAGAGTGGGACTGCATGAGTATCCCGTCGGCTCC HepC1a #66
    V  V  F  S  Q  M  E  T  K  L  I  T  W  G  A  D  T  A  A  C  G  D  I  I  N  G  L  P  V  S
GTGGTCTTCTCCCAGATGGAGACAAAGCTCATCACATGGGGAGCCGATACCGCTGCCTGTGGCGATATCATTAACGGACTGCCTGTGTCC HepC1a #79
    L  L  C  P  A  G  H  A  V  G  I  F  R  A  A  V  C  T  R  G  V  A  K  A  V  D  F  I  P  V
CTGCTCTGCCCTGCCGGACACGCTGTGGGAATCTTTAGGGCTGCCGTCTGCACAAGGGGAGTGGCTAAGGCTGTGGATTTCATTCCCGTC HepC1a #113
    C  V  V  I  V TTCACAGAGGCTATGACAAGGTATAGCGCTCCCCCTGGCGATCCCCCTCAGCCTGAGTATGACCTCGAGCTCATCACAAGCTGTAGCTCC HepC1a #54
W P L L L L L L A L P Q R A Y A L D T E V A A S C G G V V L
TGGCCTCTGCTCCTGCTCCTGCTCGCCCTCCCCCAAAGGGCTTACGCTCTGGATACCGAAGTGGCTGCCTCCTGCGGAGGCGTCGTGCTC HepC1a #70
Q Q T R G L L G C I I T S L T G R D K N Q V E G E V Q I V S
CAGCAAACCAGAGGCCTCCTGGGATGCATTATCACAAGCCTCACCGGAAGGGATAAGAATCAGGTCGAGGGAGAGGTCCAGATTGTGTCC HepC1a #82
S S P P A V P Q S F Q V A H L H A P T G S G K S T K V P A A
AGCTCCCCCCCTGCCGTCCCCCAAAGCTTTCAGGTCGCCCATCTGCATGCCCCTACCGGAAGCGGAAAGTCCACCAAAGTGCCTGCCGCT HepC1a #104
N T P G L P V C Q D H L E F W E G V F T G L T H I D A H F L
AACACACCCGGACTGCCTGTGTGTCAGGATCACCTCGAGTTTTGGGAAGGCGTCTTCACAGGCCTCACCCATATCGATGCCCATTTCCTC HepC1a #26
V L L L F A G V D A E T H V T G G N A G R T T S G L V S L L
GTGCTCCTGCTCTTCGCTGGCGTCGACGCTGAGACACACGTCACCGGAGGCAATGCCGGAAGGACAACCTCCGGCCTCGTGTCCCTGCTC HepC1a #110
E V T L T H P V T K Y I M T C M S A D L E V V T S T W V L V
GAGGTCACCCTCACCCATCCCGTCACCAAATACATTATGACATGCATGAGCGCTGACCTCGAGGTCGTGACAAGCACATGGGTCCTGGTC HepC1a #56
V G L M A L T L S P Y Y K R Y I S W C L W W L Q Y F L T R V
GTGGGACTGATGGCCCTCACCCTCAGCCCTTACTATAAGAGATACATTAGCTGGTGCCTCTGGTGGCTGCAATACTTTCTGACAAGGGTC HepC1a #197
A I C G K Y L F N W A V R T K L K L T P I A A A G R L D L S
GCCATTTGCGGAAAGTATCTGTTTAACTGGGCCGTCAGGACAAAGCTCAAGCTCACCCCTATCGCTGCCGCTGGCAGACTGGATCTGTCC HepC1a #25
I A Y F S M V G N W A K V L V V L L L F A G V D A E T H V T
ATCGCTTACTTTAGCATGGTGGGAAACTGGGCCAAAGTGCTCGTGGTCCTGCTCCTGTTTGCCGGAGTGGATGCCGAAACCCATGTGACA HepC1a #147
K L A R G S P P S M A S S S A S Q L S A P S L K A T C T A N
AGGCTCGCCAGAGGCTCCCCCCCCTAGCATGGCCTCCAGCTCCGCCTCCCAGCTCAGCGCTCCCTCCCTGAAAGCCACATGCACAGCCAAT HepC1a #52
G L V S F L V F F C F A W Y L K G R W V P G A V Y A L Y G M
GGCCTCGTGTCCTTCCTCGTGTTTTTCTGTTTCGCTTGGTATCTGAAAGGCAGATGGGTCCCCGGAGCCGTCTACGCTCTGTATGGCATG HepC1a #145
Q L P C E P E P D V A V L T S M L T D P S H I T A E A A G R
CAGCTCCCCTGTGAGCCTGAGCCTGACGTCGCCGTCCTGACAAGCATGCTGACAGACCCTAGCCATATCACAGCCGAAGCCGCTGGCAGA HepC1a #171
D S V T P I D T T I M A K N E V F C V Q P E K G G R K P A R
GACTCCGTGACACCCATTGACACAACCATTATGGCTAAGAATGAGGTCTTCTGTGTGCAACCCGAAAAGGGAGGCAGAAAGCCTGCCAGA HepC1a #84
Y A A Q G Y K V L V L N P S V A A T L G F G A Y M S K A H G
TACGCTGCCCAAGGCTATAAGGTCCTGGTCCTGAATCCCTCCGTGGCTGCCACACTGGGATTCGGAGCCTATATGTCCAAGGCTCACGGA HepC1a #14
V R N S T G L Y H V T N D C P N S S I V Y E A A D A I L H T
GTGAGAAACTCCACCGGACTGTATCACGTCACCAATGACTGTCCCAATAGCTCCATCGTCTACGAAGCCGCTGACGCTATCCTCCACACA HepC1a #175
S S Y G F Q Y S P G Q R V E F L V Q A W K S K K T P M G F S
AGCTCCTACGGATTCCAATACTCCCCCGGACAGAGAGTGGAATTCCTCGTGCAAGCCTGGAAGTCCAAGAAAACCCCTATGGGATTCTCC HepC1a #67
D T A A C G D I I N G L P V S A R R G R E I L L G P A D G M
GACACAGCCGCTTGCGGAGACATTATCAATGGCCTCCCCGTCAGCGCTAGGAGAGGCAGAGAGATTCTGCTCGGCCCTGCCGATGGCATG HepC1a #148
S Q L S A P S L K A T C T A N H D S P D A E L I E A N L L W
AGCCAACTGTCCGCCCCTAGCCTCAAGGCTACCTGTACCGCTAACCATGACTCCCCCGATGCCGAACTGATTGAGGCTAACCTCCTGTGG

Figure 26 (Cont)

HepCla #120
N P A I A S L M A F T A A V T S P L T T T S Q T L L F N I L G .
AACCCTGCCATTGCCTCCCTGATGGCCTTTACCGCTGCCGTCACCTCCCCCCTCACCACAAGCCAAACCCTCCTGTTTAACATTCTGGGA

HepCla #176
L V Q A W K S K K T P M G F S Y D T R C F D S T V T E S D I
CTGGTCCAGGCTTGGAAAAGCAAAAAGACACCCATGGGCTTTAGCTATGACACAAGGTGTTTCGATAGCACAGTGACAGAGTCCGACATT

HepCla #152
D E R E I S V P A E I L R K S R R F A Q A L P V W A R P D Y
GACGAAAGGGAAATCTCCGTGCCTGCCGAAATCCTCAGGAAAAGCAGAAGGTTTGCCCAAGCCCTCCCCGTCTGGGCTAGGCCTGACTAT

HepCla #190
M F A P T L W A R M I L M T H F F S V L I A R D Q L E Q A L
ATGTTTGCCCCTACCCTCTGGGCTAGGATGATCCTCATGACACACTTTTTCTCCGTGCTCATCGCTAGGGATCAGCTCGAGCAAGCCCTC

HepCla #96
S V I P T S G D V V V V A T D A L M T G Y T G D F D S V I D
AGCGTCATCCCTACCTCCGGCGATGTGGTCGTGGTCGCCACAGACGCTCTGATGACCGGATACACAGGCGATTTCGATAGCGTCATCGAT

HepCla #94
C H S K K K C D E L A A K L V A L G I N A V A Y Y R G L D V
TGCCATAGCAAAAAGAAATGCGATGAGCTCGCCGCTAAGCTCGTGGCTCTGGGAATCAATGCCGTCGCCTATTACAGAGGCCTCGACGTC

HepCla #46
V L P C S F T T L P A L S T G L I H L H Q N I V D V Q Y L Y
GTGCTCCCCTGTAGCTTTACCACACTGCCTGCCCTCAGCACAGGCCTCATCCATCTGCATCAGAATATCGTCGACGTCCAGTATCTGTAT

HepCla #53
K G R W V P G A V Y A L Y G M W P L L L L L A L P Q R A Y
AAGGGAAGGTGGGTGCCTGGCGCTGTGTATGCCCTCTACGGAATGTGGCCCCTCCTGCTCCTGCTCCTGGCTCTGCCTCAGAGAGCCTAT

HepCla #87
S P I T Y S T Y G K F L A D G G C S G G A Y D I I I C D E C
AGCCCTATCACATACTCCACCTATGGCAAATTCCTCGCCGATGGCGGATGCTCCGGCGGAGCCTATGACATTATCATTTGCGATGAGTGT

HepCla #196
A R S V R A R L L A R G G R A A I C G K Y L F N W A V R T K
GCCAGAAGCGTCAGGGCTAGGCTCCTGGCTAGGGGAGGCAGAGCCGCTATCTGTGGCAAATACCTCTTCAATTGGGCTGTGAGAACCAAA

HepCla #170
K A V A H I N S V W K D L L E D S V T P I D T T I M A K N E
AAGGCTGTGGCTCACATTAACTCCGTGTGGAAGGATCTGCTCGAGGATAGCGTCACCCCTATCGATACCACAATCATGGCCAAAAACGAA

HepCla #35
F T P S P V V V G T T D R S G A P T Y S W G A N D T D V F V
TTCACACCCTCCCCCGTCGTGGTCGGCACAACCGATAGGTCCGGCGCTCCCACATACTCCTGGGGAGCCAATGACACAGACGTCTTCGTC

HepCla #16
P G C V P C V R E G N A S R C W V A M T P T V A T R D G K L
CCCGGATGCGTCCCCTGTGTGAGAGAGGGAAACGCTAGCAGATGCTGGGTGGCTATGACACCCACAGTGGCTACCAGAGACGGAAAGCTC

HepCla #183
Q D C T M L V C G D D L V V I C E S A G V Q E D A A S L R A
CAGGATTGCACAATGCTCGTGTGTGGCGATGACCTCGTGGTCATCTGTGAGTCCGCCGGAGTGCAAGAGGATGCCGCTAGCCTCAGGGCT

HepCla #125
V A G A L V A F K I M S G E V P S T E D L V N L L P A I L S
GTGGCTGGCGCTCTGGTCGCCTTTAAGATTATGTCCGGCGAAGTGCCTAGCACAGAGGATCTGGTCAACCTCCTGCCTGCCATTCTGTCC

HepCla #177
Y D T R C F D S T V T E S D I R T E E A I Y Q C C D L D P Q
TACGATACCAGATGCTTTGACTCCACCGTCACCGAAAGCGATATCAGAACCGAAGAGGCTATCTATCAGTGTTGCGATCTGGATCCGCAA

HepCla #103
E L T P A E T T V R L R A Y M N T P G L P V C Q D H L E F W
GAGCTCACCCCTGCCGAAACCACAGTGAGACTGAGAGCCTATATGAATACCCCTGGCCTCCCCGTCTGCCAAGACCATCTGGAATTCTGG

HepCla #186
P Q P E Y D L E L I T S C S S N V S V A H D G A G K R V Y Y
CCCCAACCCGAATACGATCTGGAACTGATTACCTCCTGCTCCAGCAATGTGTCCGTGGCTCACGATGGCGCTGGCAAAAGGGTCTACTAT

Figure 26 (Cont)

HepC1a #9
L G K V I D T L T C G F A D L M G Y I P L V G A P L G G A A
CTGGGAAAGGTCATCGATACCCTCACCTGTGGCTTTGCCGATCTGATGGGCTATATCCCTCTGGTCGGCGCTCCCCTCGGCGGAGCCGCT

HepC1a #93
A I P L E V I K G G R H L I F C H S K K K C D E L A A K L V
GCCATTCCCCTCGAGGTCATCAAAGGCGGAAGGCATCTGATTTTCTGTCACTCCAAGAAAAAGTGTGACGAACTGGCTGCCAAACTGGTC

HepC1a #112
G G V L A A L A A Y C L S T G C V V I V G R I V L S G K P A
GGCGGAGTGCTCGCCGCTCTGGCTGCCTATTGCCTCAGCACAGGCTGTGTGGTCATCGTCGGCAGAATCGTCCTGTCCGGCAAACCCGCT

HepC1a #184
C E S A G V Q E D A A S L R A F T E A M T R Y S A P P G D P
TGCGAAAGCGCTGGCGTCCAGGAAGACGCTGCCTCCCTGAGAGCCTTTACCGAAGCCATGACCAGATACTCCGCCCCTCCCGGAGACCCT

HepC1a #199
G W F T A G Y S G G D I Y H S V S H A R P R W F W F C L L L
GGCTGGTTCACAGCCGGATACTCCGGCGGAGACATTTACCATAGCGTCAGCCATGCCAGACCCAGATGGTTTTGGTTTTGCCTCCTGCTC

HepC1a #158
S S S T S G I T G D N T T T S S E P A P S G C P P D S D A E
AGCTCCAGCACAAGCGGAATCACAGGCGATAACACAACCACAAGCTCCGAGCCTGCCCCTAGCGGATGCCCTCCCGATAGCGATGCCGAA

HepC1a #100
R T Q R R G R T G R G K P G I Y R F V A P G E R P S G M F D
AGGACACAGAGAAGGGGAAGGACAGGCAGAGGCAAACCCGGAATCTATAGGTTTGTGGCTCCCGGAGAGACCCTCCGGCATGTTCGAT

HepC1a #43
V R M Y V G G V E H R L E A A C N W T R G E R C D L E D R D
GTGAGAATGTATGTGGGAGGCGTCGAGCATAGGCTCGAGGCTGCCTGTAACTGGACCAGAGGCGAAAGGTGTGACCTCGAGGATAGGGAT

HepC1a #58
E A Q L H V W V P P L N V R G G R D A V I L L M C V V H P T
GAGGCTCAGCTCCACGTCTGGGTCCCCCCTCTGAATGTGAGAGGCGGAAGGGATGCCGTCATCCTCCTGATGTGCGTCGTGCATCCCACA

HepC1a #4
L G V R A T R K T S E R S Q P R G R R Q P I P K A R R P E G
CTGGGAGTGAGAGCCACAAGGAAAACCTCCGAGAGAAGCCAACCCAGAGGCAGAAGGCAACCCATTCCCAAAGCCAGAAGGCCTGAGGGA

HepC1a #187
N V S V A H D G A G K R V Y Y L T R D P T T P L A R A A W E
AACGTCAGCGTCGCCCATGACGGAGCCGGAAAGAGAGTGTATTACCTCACCAGAGACCCTACCACACCCCTCGCCAGAGCCGCTTGGGAA

HepC1a #159
S E P A P S G C P P D S D A E S Y S S M P P L E G E P G D P
AGCGAACCCGCTCCCTCCGGCTGTCCCCCTGACTCCGACGCTGAGTCCTACTCCAGCATGCCCCCTCTGGAAGGCGAACCCGGAGACCCT

HepC1a #63
I G G H Y V Q M A I I K L G A L T G T Y V Y N H L T P L R D
ATCGGAGGCCATTACGTCCAGATGGCCATTATCAAACTGGGAGCCCTCACCGGAACCTATGTGTATAACCATCTGACACCCCTCAGGGAT

HepC1a #126
P S T E D L V N L L P A I L S P G A L V V G V V C A A I L R
CCCTCCACCGAAGACCTCGTGAATCTGCTCCCCGCTATCCTCAGCCCTGGCGCTCTGGTCGTGGGAGTGGTCTGCGCTGCCATTCTGAGA

HepC1a #24
I L D M I A G A H W G V L A G I A Y F S M V G N W A K V L V
ATCCTCGACATGATCGCTGGCGCTCACTGGGGCGTCCTGGCTGGCATTGCCTATTTCTCCATGGTCGGCAATTGGGCTAAGGTCCTGGTC

HepC1a #7
E G C G W A G W L L S P R G S R P S W G P T D P R R R S R N
GAGGGATGCGGATGGGCTGGCTGGCTGCTCAGCCCTAGGGGAAGCAGACCCTCCTGGGGACCCACAGACCCTAGGAGAAGGTCCAGGAAT

HepC1a #21
W T T Q G C N C S I Y P G H I T G H R M A W D M M M N W S P
TGGACAACCCAAGGCTGTAACTGTAGCATTTACCCTGGCCATATCACAGGCCATAGGATGGCCTGGGACATGATGATGAACTGGAGCCCT

HepC1a #17
W V A M T P T V A T R D G K L P A T Q L R R H I D L L V G S
TGGGTCGCCATGACCCCTACCGTCGCCACAAGGGATGGCAAACTGCCTGCCACACAGCTCAGGAGACACATTGACCTCCTGGTCGGCTCC

HepC1a #42

Figure 26 (Cont)

```
              R  L  W  H  Y  P  C  T  I  N  Y  T  I  F  K  V  R  M  Y  V  G  G  V  E  H  R  L  E  A  A
              AGGCTCTGGCATTACCCTTGCACAATCAATTACACAATCTTTAAGGTCAGGATGTACGTCGGCGGAGTGGAACACAGACTGGAAGCCGCT

HepC1a #172
              V  F  C  V  Q  P  E  K  G  G  R  K  P  A  R  L  I  V  F  P  D  L  G  V  R  V  C  E  K  M
              GTGTTTTGCGTCCAGCCTGAGAAAGGCGGAAGGAAACCCGCTAGGCTCATCGTCTTCCCTGACCTCGGCGTCAGGGTCTGCGAAAAGATG

HepC1a #10
              M  G  Y  I  P  L  V  G  A  P  L  G  G  A  A  R  A  L  A  H  G  V  R  V  L  E  D  G  V  N
              ATGGGATACATTCCCCTCGTGGGAGCCCCTCTGGGAGGCGCTGCCAGAGCCCTCGCCCATGGCGTCAGGGTCCTGGAAGACGGAGTGAAT

HepC1a #27
              G  G  N  A  G  R  T  T  S  G  L  V  S  L  L  T  P  G  A  K  Q  N  I  Q  L  I  N  T  N  G
              GGCGGAAACGCTGGCAGAACCACAAGCGGACTGGTCAGCCTCCTGACACCCGGAGCCAAACAGAATATCCAACTGATTAACACAAACGGA

HepC1a #13
              L  A  L  L  S  C  L  T  V  P  A  S  A  Y  Q  V  R  N  S  T  G  L  Y  H  V  T  N  D  C  P
              CTGGCTCTGCTCAGCTGTCTGACAGTGCCTGCCTCCGCCTATCAGGTCAGGAATAGCACAGGCCTCTACCATGTGACAAACGATTGCCCT

HepC1a #71
              G  R  D  K  N  Q  V  E  G  E  V  Q  I  V  S  T  A  A  Q  T  F  L  A  T  C  I  N  G  V  C
              GGCAGAGACAAAAACCAAGTGGAAGGCGAAGTGCAAATCGTCAGCACAGCCGCTCAGACATTCCTCGCCACATGCATTAACGGAGTGTGT

HepC1a #18
              P  A  T  Q  L  R  R  H  I  D  L  L  V  G  S  A  T  L  C  S  A  L  Y  V  G  D  L  C  G  S
              CCCGCTACCCAACTGAGAAGGCATATCGATCTGCTCGTGGGAAGCGCTACCCTCTGCTCCGCCCTCTACGTCGGCGATCTGTGTGGCTCC

HepC1a #83
              H  A  P  T  G  S  G  K  S  T  K  V  P  A  A  Y  A  A  Q  G  Y  K  V  L  V  L  N  P  S  V
              CACGCTCCCACAGGCTCCGGCAAAAGCACAAAGGTCCCCGCTGCCTATGCCGCTCAGGGATACAAAGTGCTCGTGCTCAACCCTAGCGTC

HepC1a #6
              R  T  W  A  Q  P  G  Y  P  W  P  L  Y  G  N  E  G  C  G  W  A  G  W  L  L  S  P  R  G  S
              AGGACATGGGCTCAGCCTGGCTATCCCTGGCCCCTCTACGGAAACGAAGGCTGTGGCTGGGCCGGATGGCTCCTGTCCCCCAGAGGCTCC

HepC1a #162
              T  E  D  V  V  C  C  S  M  S  Y  S  W  T  G  A  L  V  T  P  C  A  A  E  E  Q  K  L  P  I
              ACCGAAGACGTCGTGTGTTGCTCCATGTCCTACTCCTGGACAGGCGCTCTGGTCACCCCTTGCGCTGCCGAAGAGCAAAAGCTCCCCATT

HepC1a #55
              A  L  D  T  E  V  A  A  S  C  G  G  V  V  L  V  G  L  M  A  L  T  L  S  P  Y  Y  K  R  Y
              GCCCTCGACACAGAGGTCGCCGCTAGCTGTGGCGGAGTGGTCCTGGTCGGCCTCATGGCTCTGACACTGTCCCCCTATTACAAAAGGTAT

HepC1a #38
              W  M  N  S  T  G  F  T  K  V  C  G  A  P  P  C  V  I  G  G  A  G  N  N  T  L  H  C  P  T
              TGGATGAACTCCACCGGATTCACAAAGGTCTGCGGAGCCCCTCCCTGTGTGATTGGCGGAGCCGGAAACAATACCCTCCACTGTCCCACA

HepC1a #168
              S  V  E  E  A  C  S  L  T  P  P  H  S  A  K  S  K  F  G  Y  G  A  K  D  V  R  C  H  A  R
              AGCGTCGAGGAAGCCTGTAGCCTCACCCCTCCCCATAGCGCTAAGTCCAAGTTTGGCTATGGCGCTAAGGATGTGAGATGCCATGCCAGA

HepC1a #119
              I  S  G  I  Q  Y  L  A  G  L  S  T  L  P  G  N  P  A  I  A  S  L  M  A  F  T  A  A  V  T
              ATCTCCGGCATTCAGTATCTGGCTGGCCTCAGCACACTGCCTGGCAATCCCGCTATCGCTAGCCTCATGGCTTTCACAGCCGCTGTGACA

HepC1a #3
              Q  I  V  G  G  V  Y  L  L  P  R  R  G  P  R  L  G  V  R  A  T  R  K  T  S  E  R  S  Q  P
              CAGATTGTGGGAGGCGTCTACCTCCTGCCTAGGAGAGGCCCTAGGCTCGGCGTCAGGGCTACCAGAAAGACAAGCGAAAGGTCCCAGCCT

HepC1a #194
              L  H  S  Y  S  P  G  E  I  N  R  V  A  A  C  L  R  K  L  G  V  P  P  L  R  A  W  R  H  R
              CTGCATAGCTATAGCCCTGGCGAAATCAATAGGGTCGCCGCTTGCCTCAGGAAACTGGGAGTGCCTCCCCTCAGGGCTTGGAGACACAGA

HepC1a #189
              T  A  R  H  T  P  V  N  S  W  L  G  N  I  I  M  F  A  P  T  L  W  A  R  M  I  L  M  T  H
              ACCGCTAGGCATACCCCTGTGAATAGCTGGCTGGGAAACATTATCATGTTCGCTCCCACACTGTGGGCCAGAATGATTCTGATGACCCAT

HepC1a #81
              E  N  L  E  T  T  M  R  S  P  V  F  T  D  N  S  S  P  P  A  V  P  Q  S  F  Q  V  A  H  L
              GAGAATCTGGAAACCACAATGAGAAGCCCTGTGTTTACCGATAACTCCAGCCCTCCCGCTGTGCCTCAGTCCTTCCAAGTGGCTCACCTC

HepC1a #91
              A  T  P  P  G  S  V  T  V  P  H  P  N  I  E  E  V  A  L  S  T  T  G  E  I  P  F  Y  G  K
```

Figure 26 (Cont)

GCCACACCCCCTGGCTCCGTGACAGTGCCTCACCCTAACATTGAGGAAGTGGCTCTGTCCACCACAGGCGAAATCCCTTTCTATGGCAAA

HepC1a #60
L V F D I T K L L L A V F G P L W I L Q A S L L K V P Y F V
CTGGTCTTCGATATCACAAAGCTCCTGCTCGCCGTCTTCGGACCCCTCTGGATTCTGCAAGCCTCCCTGCTCAAGGTCCCCTATTTCGTC

HepC1a #23
T A A L V M A Q L L R I P Q A I L D M I A G A H W G V L A G
ACCGCTGCCCTCGTGATGGCCCAACTGCTCAGGATTCCCCAAGCCATTCTGGATATGATTGCCGGAGCCCATTGGGGAGTGCTCGCCGGA

HepC1a #98
C N T C V T Q T V D F S L D P T F T I E T T T L P Q D A V S
TGCAATACCTGTGTGACACAGACAGTGGATTTCTCCCTGGATCCCACATTCACAATCGAAACCACAACCCTCCCCCAAGACGCTGTGTCC

HepC1a #109
H G P T P L L Y R L G A V Q N E V T L T H P V T K Y I M T C
CACGGACCCACACCCCTCCTGTATAGGCTCGGCGCTGTGCAAAACGAAGTGACACTGACACACCCTGTGACAAAGTATATCATGACCTGT

HepC1a #179
A R V A I K S L T E R L Y V G G P L T N S R G E N C G Y R R
GCCAGAGTGGCTATCAAAAGCCTCACCGAAAGGCTCTACGTCGGCGGACCCCTCACCAATAGCAGAGGCGAAAACTGTGGCTATAGGAGA

HepC1a #39
C V I G G A G N N T L H C P T D C F R K H P E A T Y S R C G
TGCGTCATCGGAGGCGCTGGCAATAACACACTGCATTGCCCTACCGATTGCTTTAGGAAACACCCTGAGGCTACCTATAGCAGATGCGGA

HepC1a #76
T C G S S D L Y L V T R H A D V I P V R R R G D S R G S L L
ACCTGTGGCTCCAGCGATCTGTATCTGGTCACCAGACACGCTGACGTCATCCCTGTGAGAAGGAGAGGCGATAGCAGAGGCTCCCTGCTC

HepC1a #138
N M W S G T F P I N A Y T T G P C T P L P A P N Y T F A L W
AACATGTGGTCCGGCACATTCCCTATCAATGCCTATACCACAGGCCCTTGCACACCCCTCCCCGCTCCCAATTACACATTCGCTCTGTGG

HepC1a #89
H S T D A T S I L G I G T V L D Q A E T A G A R L V V L A T
CACTCCACCGATGCCACAAGCATTCTGGGAATCGGAACCGTCCTGGATCAGGCTGAGACAGCCGGAGCCAGACTGGTCGTGCTCGCCACA

HepC1a #130
Y V P E S D A A A R V T A I L S S L T V T Q L L R R L H Q W
TACGTCCCCGAAAGCGATGCCGCTGCCAGAGTGACAGCCATTCTGTCCAGCCTCACCGTCACCCAACTGCTCAGGAGACTGCATCAGTGG

HepC1a #8
R P S W G P T D P R R R S R N L G K V I D T L T C G F A D L
AGGCCTAGCTGGGGCCCTACCGATCCCAGAAGGAGAAGCAGAAACCTCGGCAAAGTGATTGACACACTGACATGCGGATTCGCTGACCTC

HepC1a #33
G P D Q R P Y C W H Y P P K P C G I V P A K S V C G P V Y C
GGCCCTGACCAAAGGCCTTACTGTTGGCATTACCCTCCCAAACCCTGTGGCATTGTGCCTGCCAAAAGCGTCTGCGGACCCGTCTACTGT

HepC1a #115
E E C S Q H L P Y I E Q G M M L A E Q F K Q K A L G L L Q T
GAGGAATGCTCCCAGCATCTGCCTTACATTGAGCAAGGCATGATGCTCGCCGAACAGTTTAAGCAAAAGGCTCTGGGACTGCTCCAGACA

HepC1a #107
Y Q A T V C A R A Q A P P P S W D Q M W K C L I R L K P T L
TACCAAGCCACAGTGTGTGCCAGAGCCCAAGCCCCTCCCCCTAGCTGGGACCAAATGTGGAAGTGTCTGATTAGGCTCAAGCCTACCCTC

HepC1a #34
C G I V P A K S V C G P V Y C F T P S P V V V G T T D R S G
TGCGGAATCGTCCCCGCTAAGTCCGTGTGTGGCCCTGTGTATTGCTTTACCCCTAGCCCTGTGGTCGTGGGAACCACAGACAGAAGCGGA

HepC1a #131
S S L T V T Q L L R R L H Q W I S S E C T T P C S G S W L R
AGCTCCCTGACAGTGACACAGCTCCTGAGAAGGCTCCACCAATGGATTAGCTCCGAGTGTACCACACCCTGTAGCGGAAGCTGGCTGAGA

HepC1a #161
D L S D G S W S T V S S E A G T E D V V C C S M S Y S W T G
GACCTCAGCGATGGCTCCTGGTCCACCGTCAGCTCCGAGGCTGGCACAGAGGATGTGGTCTGCTGTAGCATGAGCTATAGCTGGACCGGA

HepC1a #108
W D Q M W K C L I R L K P T L H G P T P L L Y R L G A V Q N
TGGGATCAGATGTGGAAATGCCTCATCAGACTGAAACCCACACTGCATGGCCCTACCCCTCTGCTCTACAGACTGGGAGCCGTCCAGAAT

Figure 26 (Cont)

HepC1a #116
L A E Q F K Q K A L G L L Q T A S R Q A E V I A P A V Q T N
CTGGCTGAGCAATTCAAACAGAAAGCCCTCGGCCTCCTGCAAACCGCTAGCAGACAGGCTGAGGTCATCGCTCCCGCTGTGCAAACCAAT

HepC1a #118
W Q K L E V F W A K H M W N F I S G I Q Y L A G L S T L P G
TGGCAAAAGCTCGAGGTCTTCTGGGCCAAACACATGTGGAATTTCATTAGCGGAATCCAATACCTCGCCGGACTGTCCACCCTCCCCGGA

HepC1a #129
L I A F A S R G N H V S P T H Y V P E S D A A A R V T A I L
CTGATTGCCTTTGCCTCCAGGGGAAACCATGTGTCCCCCACACACTATGTGCCTGAGTCCGACGCTGCCGCTAGGGTCACCGCTATCCTC

HepC1a #19
A T L C S A L Y V G D L C G S V F L V G Q L F T F S P R R H
GCCACACTGTGTAGCGCTCTGTATGTGGGAGACCTCTGCGGAAGCGTCTTCCTCGTGGGACAGCTCTTCACATTCTCCCCCAGAAGGCAT

HepC1a #102
S S V L C E C Y D A G C A W Y E L T P A E T T V R L R A Y M
AGCTCCGTGCTCTGCGAATGCTATGACGCTGGCTGTGCCTGGTACGAACTGACACCCGCTGAGACAACCGTCAGGCTCAGGGCTTACATG

HepC1a #122
G W V A A Q L A A P G A A T A F V G A G L A G A A I G S V G
GGCTGGGTGGCTGCCCAACTGGCTGCCCCTGGCGCTGCCACAGCCTTTGTGGGAGCCGGACTGGCTGGCGCTGCCATTGGCTCCGTGGGA

HepC1a #29
S W H I N S T A L N C N E S L N T G W L A G L F Y Q H K F N
AGCTGGCACATTAACTCCACCGCTCTGAATTGCAATGAGTCCCTGAATACCGGATGGCTCGCCGGACTGTTTTACCAACACAAATTCAAT

HepC1a #164
N A L S N S L L R H H N L V Y S T T S R S A C Q R Q K K V T
AACGCTCTGTCCAACTCCCTGCTCAGGCATCACAATCTGGTCTACTCCACCACAAGCAGAAGCGCTTGCCAAAGGCAAAAGAAAGTGACA

HepC1a #1
A A M S T N P K P Q R K T K R N T N R R P Q D V K F P G G G
GCCGCTATGTCCACCAATCCCAAACCCCAAAGGAAAACCAAAAGGAATACCAATAGGAGACCCCAAGACGTCAAGTTTCCCGGAGGCGGA

HepC1a #106
S Q T K Q S G E N F P Y L V A Y Q A T V C A R A Q A P P P S
AGCCAAACCAAACAGTCCGGCGAAAACTTTCCCTATCTGGTCGCCTATCAGGCTACCGTCTGCGCTAGGGCTCAGGCTCCCCCTCCCTCC

HepC1a #36
A P T Y S W G A N D T D V F V L N N T R P P L G N W F G C T
GCCCCTACCTATAGCTGGGGCGCTAACGATACCGATGTGTTTGTGCTCAACAATACCAGACCCCCTCTGGGAAACTGGTTCGGATGCACA

HepC1a #156
V P P P R K K R T V V L T E S T L S T A L A E L A T K S F G
GTGCCTCCCCCTAGGAAAAAGAGAACCGTCGTGCTCACCGAAAGCACACTGTCCACCGCTCTGGCTGAGCTCGCCACAAAGTCCTTCGGA

HepC1a #165
S T T S R S A C Q R Q K K V T F D R L Q V L D S H Y Q D V L
AGCACAACCTCCAGGTCCGCCTGTCAGAGACAGAAAAAGGTCACCTTTGACAGACTGCAAGTGCTCGACTCCCACTATCAGGATGTGCTC

HepC1a #90
D Q A E T A G A R L V V L A T A T P P G S V T V P H P N I E
GACCAAGCCGAAACCGCTGGCGCTAGGCTCGTGGTCCTGGCTACCGCTACCCCTCCCGGAAGCGTCACCGTCCCCCATCCCAATATCGAA

HepC1a #141
F H Y V T G M T T D N L K C P C Q V P S P E F F T E L D G V
TTCCATTACGTCACCGGAATGACAACCGATAACCTCAAGTGTCCCTGTCAGGTCCCCTCCCCCGAATTCTTTACCGAACTGGATGGCGTC

HepC1a #198
L K L T P I A A A G R L D L S G W F T A G Y S G G D I Y H S
CTGAAACTGACACCCATTGCCGCTGCCGGAAGGCTCGACCTCAGCGGATGGTTTACCGCTGGCTATAGCGGAGGCGATATCTATCACTCC

HepC1a #117
A S R Q A E V I A P A V Q T N W Q K L E V F W A K H M W N F
GCCTCCAGGCAAGCCGAAGTGATTGCCCCTGCCGTCCAGACAAACTGGCAGAAACTGGAAGTGTTTTGGGCTAAGCATATGTGGAACTTT

HepC1a #181
C R A S G V L T T S C G N T L T C Y I K A R A A C R A A G L
TGCAGAGCCTCCGGCGTCCTGACAACCTCCTGCGGAAACACACTGACATGCTATATCAAAGCCAGAGCCGCTTGCAGAGCCGCTGGCCTC

Figure 26 (Cont)

HepC1a #166
F  D  R  L  Q  V  L  D  S  H  Y  Q  D  V  L  K  E  V  K  A  A  A  S  K  V  K  A  N  L  L
TTCGATAGGCTCCAGGTCCTGGATAGCCATTACCAAGACGTCCTGAAAGAGGTCAAGGCTGCCGCTAGCAAAGTGAAAGCCAATCTGCTC

HepC1a #180
G  P  L  T  N  S  R  G  E  N  C  G  Y  R  R  C  R  A  S  G  V  L  T  T  S  C  G  N  T  L
GGCCCTCTGACAAACTCCAGGGGAGAGAATTGCGGATACAGAAGGTGTAGGGCTAGCGGAGTGCTCACCACAAGCTGTGGCAATACCCTC

HepC1a #136
I  M  H  T  R  C  H  C  G  A  E  I  T  G  H  V  K  N  G  T  M  R  I  V  G  P  R  T  C  R
ATCATGCACACAAGGTGTCACTGTGGCGCTGAGATTACCGGACACGTCAAGAATGGCACAATGAGAATCGTCGGCCCTAGGACATGCAGA

HepC1a #144
E  V  S  F  R  V  G  L  H  E  Y  P  V  G  S  Q  L  P  C  E  P  E  P  D  V  A  V  L  T  S
GAGGTCAGCTTTAGGGTCGGCCTCCACGAATACCCTGTGGGAAGCCAACTGCCTTGCGAACCCGAACCCGATGTGGCTGTGCTCACCTCC

HepC1a #167
K  E  V  K  A  A  A  S  K  V  K  A  N  L  L  S  V  E  E  A  C  S  L  T  P  P  H  S  A  K
AAGGAAGTGAAAGCCGCTGCCTCCAAGGTCAAGGCTAACCTCCTGTCCGTGGAAGAGGCTTGCTCCCTGACACCCCCTCACTCCGCCAAA

HepC1a #59
G  R  D  A  V  I  L  L  M  C  V  V  H  P  T  L  V  F  D  I  T  K  L  L  L  A  V  F  G  P
GGCAGAGACGCTGTGATTCTGCTCATGTGTGTGGTCCACCCTACCCTCGTGTTTGACATTACCAAACTGCTCCTGGCTGTGTTTGGCCCT

HepC1a #146
M  L  T  D  P  S  H  I  T  A  E  A  A  G  R  R  L  A  R  G  S  P  P  S  M  A  S  S  S  A
ATGCTCACCGATCCCTCCCACATTACCGCTGAGGCTGCCGGAAGGAGACTGGCTAGGGGAAGCCCTCCCTCCATGGCTAGCTCCAGCGCT

HepC1a #78
S  P  R  P  I  S  Y  L  K  G  S  S  G  G  P  L  L  C  P  A  G  H  A  V  G  I  F  R  A  A
AGCCCTAGGCCTATCTCCTACCTCAAGGGAAGCTCCGGCGGACCCCTCCTGTGTCCCGCTGGCCATGCCGTCGGCATTTTCAGAGCCGCT

HepC1a #32
D  F  D  Q  G  W  G  P  I  S  Y  A  N  G  S  G  P  D  Q  R  P  Y  C  W  H  Y  P  P  K  P
GACTTTGACCAAGGCTGGGGCCCTATCTCCTACGCTAACGGAAGCGGACCCGATCAGAGACCCTATTGCTGGCACTATCCCCCTAAGCCT

HepC1a #128
R  H  V  G  P  G  E  G  A  V  Q  W  M  N  R  L  I  A  F  A  S  R  G  N  H  V  S  P  T  H
AGGCATGTGGGACCCGGAGAGGGAGCCGTCCAGTGGATGAATAGGCTCATCGCTTTCGCTAGCAGAGGCAATCACGTCAGCCCTACCCAT

HepC1a #50
C  L  W  M  M  L  L  I  S  Q  A  E  A  A  L  E  N  L  V  I  L  N  A  A  S  L  A  G  T  H
TGCCTCTGGATGATGCTCCTGATTAGCCAAGCCGAAGCCGCTCTGGAAAAACCTCGTGATTCTGAATGCCGCTAGCCTCGCCGGAACCCAT

HepC1a #114
I  I  P  D  R  E  V  L  Y  R  E  F  D  E  M  E  E  C  S  Q  H  L  P  Y  I  E  Q  G  M  M
ATCATTCCCGATAGGGAAGTGCTCTACAGAGAGTTTGACGAAATGGAAGAGTGTAGCCAACACCTCCCCTATATCGAACAGGGAATGATG

HepC1a #47
L  I  H  L  H  Q  N  I  V  D  V  Q  Y  L  Y  G  V  G  S  S  I  A  S  W  A  I  K  W  E  Y
CTGATTCACCTCCACCAAAACATTGTGGATGTGCAATACCTCTACGGAGTGGGAAGCTCCATCGCTAGCTGGGCCATTAAGTGGGAGTAT

HepC1a #200
V  S  H  A  R  P  R  W  F  W  F  C  L  L  L  L  A  A  G  V  G  I  Y  L  L  P  N  R  A  A
GTGTCCCACGCTAGGCCTAGGTGGTTCTGGTTCTGTCTGCTCCTGCTCGCCGCTGGCGTCGGCATTTACCTCCTGCCTAACAGAGCCGCT

HepC1a #85
A  A  T  L  G  F  G  A  Y  M  S  K  A  H  G  I  D  P  N  I  R  T  G  V  R  T  I  T  T  G
GCCGCTACCCTCGGCTTTGGCGCTTACATGAGCAAAGCCCATGGCATTGACCCTAACATTAGGACAGGCGTCAGGACAATCACAACCGGA

HepC1a #62
R  V  Q  G  L  L  R  I  C  A  L  A  R  K  M  I  G  G  H  Y  V  Q  M  A  I  I  K  L  G  A
AGGGTCCAGGGACTGCTCAGGATTTGCGCTCTGGCTAGGAAAATGATTGGCGGACACTATGTGCAAATGGCTATCATTAAGCTCGGCGCT

HepC1a #153
R  R  F  A  Q  A  L  P  V  W  A  R  P  D  Y  N  P  P  L  V  E  T  W  K  K  P  D  Y  E  P
AGGAGATTCGCTCAGGCTCTGCCTGTGTGGGCCAGACCCGATTACAATCCCCCTCTGGTCGAGACATGGAAAAAGCCTGACTATGAGCCT

HepC1a #72
T  A  A  Q  T  F  L  A  T  C  I  N  G  V  C  W  T  V  Y  H  G  A  G  T  R  T  I  A  S  P
ACCGCTGCCCAAACCTTTCTGGCTACCTGTATCAATGGCGTCTGCTGGACCGTCTACCATGGCGCTGGCACAAGGACAATCGCTAGCCCT

HepC1a #65

Figure 26 (Cont)

```
       W  A  H  N  G  L  R  D  L  A  V  A  V  E  P  V  V  F  S  Q  M  E  T  K  L  I  T  W  G  A
       TGGGCTCACAATGGCCTCAGGGATCTGGCTGTGGCTGTGGAACCCGTCGTGTTTAGCCAAATGGAAACCAAACTGATTACCTGGGCGCT

HepC1a #74
       K  G  P  V  I  Q  M  Y  T  N  V  D  Q  D  L  V  G  W  P  A  P  Q  G  S  R  S  L  T  P  C
       AAGGGACCCGTCATCCAAATGTATACCAATGTGGATCAGGATCTGGTCGGCTGGCCCGCTCCCCAAGGCTCCAGGTCCCTGACACCCTGT

HepC1a #151
       K  V  V  I  L  D  S  F  D  P  L  V  A  E  E  D  E  R  E  I  S  V  P  A  E  I  L  R  K  S
       AAGGTCGTGATTCTGGATAGCTTTGACCCTCTGGTCGCCGAAGAGGATGAGAGAGAGATTAGCGTCCCCGCTGAGATTCTGAGAAAGTCC

HepC1a #64
       L  T  G  T  Y  V  V  Y  N  H  L  T  P  L  R  D  W  A  H  N  G  L  R  D  L  A  V  A  V  E  P
       CTGACAGGCACATACGTCTACAATCACCTCACCCCTCTGAGAGACTGGGCCCATAACGGACTGAGAGACCTCGCCGTCGCCGTCGAGCCT

HepC1a #80
       V  C  T  R  G  V  A  K  A  V  D  F  I  P  V  E  N  L  E  T  T  M  R  S  P  V  F  T  D  N
       GTGTGTACCAGAGGCGTCGCCAAAGCCGTCGACTTTATCCCTGTGGAAAACCTCGAGACAACCATGAGGTCCCCCGTCTTCACAGACAAT

HepC1a #95
       A  L  G  I  N  A  V  A  Y  Y  R  G  L  D  V  S  V  I  P  T  S  G  D  V  V  V  V  A  T  D
       GCCCTCGGCATTAACGCTGTGGCTTACTATAGGGGACTGGATGTGTCCGTGATTCCCACAAGCGGAGACGTCGTGGTCGTGGCTACCGAT

HepC1a #111
       M  S  A  D  L  E  V  V  T  S  T  W  V  L  V  G  G  V  L  A  A  L  A  A  Y  C  L  S  T  G
       ATGTCCGCCGATCTGGAAGTGGTCACCTCCACCTGGGTGCTCGTGGGAGGCGTCCTGGCTGCCCTCGCCGCTTACTGTCTGTCCACCGGA

HepC1a #97
       A  L  M  T  G  Y  T  G  D  F  D  S  V  I  D  C  N  T  C  V  T  Q  T  V  D  F  S  L  D  P
       GCCCTCATGACAGGCTATACCGGAGACTTTGACTCCGTGATTGACTGTAACACATGCGTCACCCAAACCGTCGACTTTAGCCTCGACCCT

HepC1a #2
       N  T  N  R  R  P  Q  D  V  K  F  P  G  G  G  Q  I  V  G  G  V  Y  L  L  P  R  R  G  P  R
       AACACAAACAGAAGGCCTCAGGATGTGAAATTCCCTGGCGGAGGCCAAATCGTCGGCGGAGTGTATCTGCTCCCCAGAAGGGGACCCAGA

HepC1a #11
       R  A  L  A  H  G  V  R  V  L  E  D  G  V  N  Y  A  T  G  N  L  P  G  C  S  F  S  I  F  L
       AGGGCTCTGGCTCACGGAGTGAGAGTGCTCGAGGATGGCGTCAACTATGCCACAGGCAATCTGCCTGGCTGTAGCTTTAGCATTTTCCTC

HepC1a #169
       S  K  F  G  Y  G  A  K  D  V  R  C  H  A  R  K  A  V  A  H  I  N  S  V  W  K  D  L  L  E
       AGCAAATTCGGATACGGAGCCAAAGACGTCAGGTGTCACGCTAGGAAAGCCGTCGCCCATATCAATAGCGTCTGGAAAGACCTCCTGGAA

HepC1a #28
       T  P  G  A  K  Q  N  I  Q  L  I  N  T  N  G  S  W  H  I  N  S  T  A  L  N  C  N  E  S  L
       ACCCCTGGCGCTAAGCAAAACATTCAGCTCATCAATACCAATGGCTCCTGGCATATCAATAGCACAGCCCTCAACTGTAACGAAAGCCTC

HepC1a #30
       N  T  G  W  L  A  G  L  F  Y  Q  H  K  F  N  S  S  G  C  P  E  R  L  A  S  C  R  R  L  T
       AACACAGGCTGGCTGGCTGGCCTCTTCTATCAGCATAAGTTTAACTCCAGCGGATGCCCTGAGAGACTGGCTAGCTGTAGGAGACTGACA

HepC1a #49
       V  V  L  L  F  L  L  L  A  D  A  R  V  C  S  C  L  W  M  M  L  L  I  S  Q  A  E  A  A  L
       GTGGTCCTGCTCTTCCTCCTGCTCGCCGATGCCAGAGTGTGTAGCTGTCTGTGGATGATGCTGCTCATCTCCCAGGCTGAGGCTGCCCTC

HepC1a #192
       D  C  E  I  Y  G  A  C  Y  S  I  E  P  L  D  L  P  P  I  I  Q  R  L  H  G  L  S  A  F  S
       GACTGTGAGATTTACGGAGCCTGTTACTCCATCGAACCCCTCGACCTCCCCCCTATCATTCAGAGACTGCATGGCCTCAGCGCTTTCTCC

HepC1a #73
       W  T  V  Y  H  G  A  G  T  R  T  I  A  S  P  K  G  P  V  I  Q  M  Y  T  N  V  D  Q  D  L
       TGGACAGTGTATCACGGAGCCGGAACCAGAACCATTGCCTCCCCCAAAGGCCCTGTGATTCAGATGTACACAAACGTCGACCAAGACCTC

HepC1a #101
       Y  R  F  V  A  P  G  E  R  P  S  G  M  F  D  S  S  V  L  C  E  C  Y  D  A  G  C  A  W  Y
       TACAGATTCGTCGCCCCTGGCGAAAGGCCTAGCGGAATGTTTGACTCCAGCGTCCTGTGTGAGTGTTACGATGCCGGATGCGCTTGGTAT

HepC1a #45
       R  S  E  L  S  P  L  L  L  S  T  T  Q  W  Q  V  L  P  C  S  F  T  T  L  P  A  L  S  T  G
       AGGTCCGAGCTCAGCCCTCTGCTCCTGTCCACCACACAGTGGCAGGTCCTGCCTTGCTCCTTCACAACCCTCCCCGCTCTGTCCACCGGA

HepC1a #195
       L  R  K  L  G  V  P  P  L  R  A  W  R  H  R  A  R  S  V  R  A  R  L  L  A  R  G  G  R  A
```

Figure 26 (Cont)

CTGAGAAAGCTCGGCGTCCCCCCTCTGAGAGCCTGGAGGCATAGGGCTAGGTCCGTGAGAGCCAGACTGCTCGCCAGAGGCGGAAGGGCT

HepC1a #121
```
  S  P  L  T  T  S  Q  T  L  L  F  N  I  L  G  G  W  V  A  A  Q  L  A  A  P  G  A  A  T  A
AGCCCTCTGACAACCTCCCAGACACTGCTCTTCAATATCCTCGGCGGATGGGTCGCCGCTCAGCTCGCCGCTCCCGGAGCCGCTACCGCT
```

HepC1a #61
```
  L  W  I  L  Q  A  S  L  L  K  V  P  Y  F  V  R  V  Q  G  L  L  R  I  C  A  L  A  R  K  M
CTGTGGATCCTCCAGGCTAGCCTCCTGAAAGTGCCTTACTTTGTGAGAGTGCAAGGCCTCCTGAGAATCTGTGCCCTCGCCAGAAAGATG
```

HepC1a #137
```
  V  K  N  G  T  M  R  I  V  G  P  R  T  C  R  N  M  W  S  G  T  F  P  I  N  A  Y  T  T  G
GTGAAAAACGGAACCATGAGGATTGTGGGACCCAGAACCTGTAGGAATATGTGGAGCGGAACCTTTCCCATTAACGCTTACACAACCGGA
```

HepC1a #92
```
  E  V  A  L  S  T  T  G  E  I  P  F  Y  G  K  A  I  P  L  E  V  I  K  G  G  R  H  L  I  F
GAGGTCGCCCTCAGCACAACCGGAGAGATTCCCTTTTACGGAAAGGCTATCCCTCTGGAAGTGATTAAGGGAGGCAGACACCTCATCTTT
```

HepC1a #188
```
  L  T  R  D  P  T  T  P  L  A  R  A  A  W  E  T  A  R  H  T  P  V  N  S  W  L  G  N  I  I
CTGACAAGGGATCCCACAACCCCTCTGGCTAGGGCTGCCTGGGAGACAGCCAGACACACACCCGTCAACTCCTGGCTCGGCAATATCATT
```

HepC1a #140
```
  R  V  S  A  E  E  Y  V  E  I  R  R  V  G  D  F  H  Y  V  T  G  M  T  T  D  N  L  K  C  P
AGGGTCAGCGCTGAGGAATACGTCGAGATTAGGAGAGTGGGAGACTTTCACTATGTGACAGGCATGACCACAGACAATCTGAAATGCCCT
```

HepC1a #155
```
  P  V  V  H  G  C  P  L  P  P  P  R  S  P  P  V  P  P  P  R  K  K  R  T  V  V  L  T  E  S
CCCGTCGTGCATGGCTGTCCCCTCCCCCCTCCCAGAAGCCCTCCCGTCCCCCCTCCCAGAAAGAAAAGGACAGTGGTCCTGACAGAGTCC
```

HepC1a #157
```
  T  L  S  T  A  L  A  E  L  A  T  K  S  F  G  S  S  S  T  S  G  I  T  G  D  N  T  T  T  S
ACCCTCAGCACAGCCCTCGCCGAACTGGCTACCAAAAGCTTTGGCTCCAGCTCCACCTCCGGCATTACCGGAGACAATACCACAACCTCC
```

HepC1a #135
```
  V  S  C  Q  R  G  Y  K  G  V  W  R  G  D  G  I  M  H  T  R  C  H  C  G  A  E  I  T  G  H
GTGTCCTGCCAAAGGGGATACAAAGGCGTCTGGAGAGGCGATGGCATTATGCATACCAGATGCCATTGCGGAGCCGAAATCACAGGCCAT
```

HepC1a #20
```
  V  F  L  V  G  Q  L  F  T  F  S  P  R  R  H  W  T  T  Q  G  C  N  C  S  I  Y  P  G  H  I
GTGTTTCTGGTCGGCCAACTGTTTACCTTTAGCCCTAGGAGACACTGGACCACACAGGGATGCAATTGCTCCATCTATCCCGGACACATT
```

HepC1a #123
```
  F  V  G  A  G  L  A  G  A  A  I  G  S  V  G  L  G  K  V  L  V  D  I  L  A  G  Y  G  A  G
TTCGTCGGCGCTGGCCTCGCCGGAGCCGCTATCGGAAGCGTCGGCCTCGGCAAAGTGCTCGTGGATATCCTCGCCGGATACGGAGCCGGA
```

HepC1a #133
```
  D  I  W  D  W  I  C  E  V  L  S  D  F  K  T  W  L  K  A  K  L  M  P  Q  L  P  G  I  P  F
GACATTTGGGATTGGATTTGCGAAGTGCTCAGCGATTTCAAAACCTGGCTGAAAGCCAAACTGATGCCCCAACTGCCTGGCATTCCCTTT
```

HepC1a #15
```
  N  S  S  I  V  Y  E  A  A  D  A  I  L  H  T  P  G  C  V  P  C  V  R  E  G  N  A  S  R  C
AACTCCAGCATTGTGTATGAGGCTGCCGATGCCATTCTGCATACCCCTGGCTGTGTGCCTTGCGTCAGGGAAGGCAATGCCTCCAGGTGT
```

HepC1a #31
```
  S  S  G  C  P  E  R  L  A  S  C  R  R  L  T  D  F  D  Q  G  W  G  P  I  S  Y  A  N  G  S
AGCTCCGGCTGTCCCGAAAGGCTCGCCTCCTGCAGAAGGCTCACCGATTTCGATCAGGGATGGGGACCCATTAGCTATGCCAATGGCTCC
```

HepC1a #178
```
  R  T  E  E  A  I  Y  Q  C  C  D  L  D  P  Q  A  R  V  A  I  K  S  L  T  E  R  L  Y  V  G
AGGACAGAGGAAGCCATTTACCAATGCTGTGACCTCGACCCTCAGGCTAGGGTCGCCATTAAGTCCCTGACAGAGAGACTGTATGTGGGA
```

HepC1a #69
```
  V  S  K  G  W  R  L  L  A  P  I  T  A  Y  A  Q  Q  T  R  G  L  L  G  C  I  I  T  S  L  T
GTGTCCAAGGGATGGAGACTGCTCGCCCCTATCACAGCCTATGCCCAACAGACAAGGGGACTGCTCGGCTGTATCATTACCTCCCTGACA
```

HepC1a #191
```
  F  F  S  V  L  I  A  R  D  Q  L  E  Q  A  L  D  C  E  I  Y  G  A  C  Y  S  I  E  P  L  D
TTCTTTAGCGTCCTGATTGCCAGAGACCAACTGGAACAGGCTCTGGATTGCGAAATCTATGGCGCTTGCTATAGCATTGAGCCTCTGGAT
```

HepC1a #142
```
  C  Q  V  P  S  P  E  F  F  T  E  L  D  G  V  R  L  H  R  F  A  P  P  C  K  P  L  L  R  E
TGCCAAGTGCCTAGCCCTGAGTTTTTCACAGAGCTCGACGGAGTGAGACTGCATAGGTTTGCCCCTCCCTGTAAGCCTCTGCTCAGGGAA
```

Figure 26 (Cont)

HepCla #182
T C Y I K A R A A C R A A G L Q D C T M L V C G D D L V V I
ACCTGTTACATTAAGGCTAGGGCTGCCTGTAGGGCTGCCGGACTGCAAGACTGTACCATGCTGGTCTGCGGAGACGATCTGGTCGTGATT

HepCla #86
I D P N I R T G V R T I T T G S P I T Y S T Y G K F L A D G
ATCGATCCCAATATCAGAACCGGAGTGAGAACCATTACCACAGGCTCCCCCATTACCTATAGCACATACGGAAAGTTTCTGGCTGACGGA

HepCla #44
C N W T R G E R C D L E D R D R S E L S P L L L S T T Q W Q
TGCAATTGGACAAGGGGAGAGAGATGCGATCTGGAAGACAGAGACAGAAGCGAACTGTCCCCCCTCCTGCTCAGCACAACCCAATGGCAA

HepCla #22
T G H R M A W D M M M N W S P T A A L V M A Q L L R I P Q A
ACCGGACACAGAATGGCTTGGGATATGATGATGAATTGGTCCCCCACAGCCGCTCTGGTCATGGCTCAGCTCCTGAGAATCCCTCAGGCT

HepCla #127
P G A L V V G V V C A A I L R R H V G P G E G A V Q W M N R
CCCGGAGCCCTCGTGGTCGGCGTCGTGTGTGCCGCTATCCTCAGGAGACACGTCGGCCCTGGCGAAGGCGCTGTGCAATGGATGAACAGA

HepCla #149
H D S P D A E L I E A N L L W R Q E M G G N I T R V E S E N
CACGATAGCCCTGACGCTGAGCTCATCGAAGCCAATCTGCTCTGGAGACAGGAAATGGGAGGCAATATCACAAGGGTCGAGTCCGAGAAT

HepCla #105
E G V F T G L T H I D A H F L S Q T K Q S G E N F P Y L V A
GAGGGAGTGTTTACCGGACTGACACACATTGACGCTCACTTTCTGTCCCAGACAAAGCAAAGCGGAGAGAATTTCCCTTACCTCGTGGCT

HepCla #5
R G R R Q P I P K A R R P E G R T W A Q P G Y P W P L Y G N
AGGGGAAGGAGACAGCCTATCCCTAAGGCTAGGAGACCCGAAGGCAGAACCTGGGCCCAACCCGGATACCCTTGGCCTCTGTATGGCAAT

HepCla #173
L I V F P D L G V R V C E K M A L Y D V V S K L P L A V M G
CTGATTGTGTTTCCCGATCTGGGAGTGAGAGTGTGTGAGAAAATGGCTCTGTATGACGTCGTGTCCAAGCTCCCCCTCGCCGTCATGGGA

HepCla #12
Y A T G N L P G C S F S I F L L A L L S C L T V P A S A Y Q
TACGCTACCGGAAACCTCCCCGGATGCTCCTTCTCCATCTTTCTGCTCGCCCTCCTGTCCTGCCTCACCGTCCCCGCTAGCGCTTACCAA

HepCla #124
L G K V L V D I L A G Y G A G V A G A L V A F K I M S G E V
CTGGGAAAGGTCCTGGTCGACATTCTGGCTGGCTATGGCGCTGGCGTCGCCGGAGCCCTCGTGGCTTTCAAAATCATGAGCGGAGAGGTC

HepCla #160
S Y S S M P P L E G E P G D P D L S D G S W S T V S S E A G
AGCTATAGCTCCATGCCTCCCCTCGAGGGAGAGCCTGGCGATCCCGATCTGTCCGACGGAAGCTGGAGCACAGTGTCCAGCGAAGCCGGA

HepCla #150
R Q E M G G N I T R V E S E N K V V I L D S F D P L V A E E
AGGCAAGAGATGGGCGGAAACATTACCAGAGTGGAAAGCGAAAACAAAGTGGTCATCCTCGACTCCTTCGATCCCCTCGTGGCTGAGGAA

HepCla #75
V G W P A P Q G S R S L T P C T C G S S D L Y L V T R H A D
GTGGGATGGCCTGCCCCTCAGGGAAGCAGAAGCCTCACCCCTTGCACATGCGGAAGCTCCGACCTCTACCTCGTGACAAGGCATGCCGAT

HepCla #88
G C S G G A Y D I I I C D E C H S T D A T S I L G I G T V L
GGCTGTAGCGGAGGCGCTTACGATATCATTATCTGTGACGAATGCCATAGCACAGACGCTACCTCCATCCTCGGCATTGGCACAGTGCTC

HepCla #99
T F T I E T T T L P Q D A V S R T Q R R G R T G R G K P G I
ACCTTTACCATTGAGACAACCACACTGCCTCAGGATGCCGTCAGCAGAACCCAAAGGAGAGGCAGAACCGGAAGGGGAAAGCCTGGCATT

HepCla #40
D C F R K H P E A T Y S R C G S G P W I T P R C L V D Y P Y
GACTGTTTCAGAAAGCATCCCGAAGCCACATACTCCAGGTGTGGCTCCGGCCCTTGGATTACCCCTAGGTGTCTGGTCGACTATCCCTAT

HepCla #201
L A A G V G I Y L L P N R A A
CTGGCTGCCGGAGTGGGAATCTATCTGCTCCCCAATAGGGCTGCC

Figure 26 (Cont)

HepC1a #163
```
  A   L   V   T   P   C   A   A   E   E   Q   K   L   P   I   N   A   L   S   N   S   L   L   R   H   H   N   L   V   Y
GCCCTCGTGACACCCTGTGCCGCTGAGGAACAGAAACTGCCTATCAATGCCCTCAGCAATAGCCTCCTGAGACACCATAACCTCGTGTAT
```

HepC1a #132
```
  I   S   S   E   C   T   T   P   C   S   G   S   W   L   R   D   I   W   D   W   I   C   E   V   L   S   D   F   K   T
ATCTCCAGCGAATGCACAACCCCTTGCTCCGGCTCCTGGCTCAGGGATATCTGGGACTGGATCTGTGAGGTCCTGTCCGACTTTAAGACA
```

HepC1a #134
```
  W   L   K   A   K   L   M   P   Q   L   P   G   I   P   F   V   S   C   Q   R   G   Y   K   G   V   W   R   G   D   G
TGGCTCAAGGCTAAGCTCATGCCTCAGCTCCCCGGAATCCCTTTCGTCAGCTGTCAGAGAGGCTATAAGGGAGTGTGGAGGGGAGACGGA
```

HepC1a #41
```
  S   G   P   W   I   T   P   R   C   L   V   D   Y   P   Y   R   L   W   H   Y   P   C   T   I   N   Y   T   I   F   K
AGCGGACCCTGGATCACACCCAGATGCCTCGTGGATTACCCTTACAGACTGTGGCACTATCCCTGTACCATTAACTATACCATTTTCAAA
```

Artificial Protein:
--------------------
```
VIPVRRRGDSRGSLLSPRPISYLKGSSGGPARRGREILLGPADGMVSKGWRLLAPITAYARLHRFAPPCCKPLLREEVSFRVGLHEYPVGSVVFSQMET
KLITWGADTAACGDIINGLPVSLLCPAGHAVGIFRAAVCTRGVAKAVDFIPVCVVIVGRIVLSGKPAIIPDREVLYREFDEMPCTPLPAPNYTFALWR
VSAEEYVEIRRVGDALYDVVSKLPLAVMGSSYGFQYSPGQRVEFISWCLWWLQYFLTRVEAQLHVWVPPLNVRGENLVILNAASLAGTHGLVSFLVFF
CFAWYLLPPIIQRLHGLSAPSLHSYSPGEINRVAACNPPLVETWKKPDYEPPVVHGCPLPPPRSPFGVGSSIASWAIKWEYVVLLFLLLADARVCSLN
NTRPPLGNWFGCTWMNSTGFTKVCGAPPFTEAMTRYSAPPGDPPQPEYDLELITSCSSWPLLLLLLALPQRAYALDTEVAASCGGVVLQQTRGLLGCI
ITSLTGRDKNQVEGEVQIVSSSPPAVPQSFQVAHLHAPTGSGKSTKVPAANTPGLPVCQDHLEFWEGVFTGLTHIDAHFLVLLLFAGVDAETHVTGGN
AGRTTSGLVSLLEVTLTHPVTKYIMTCMSADLEVVTSTWVLVVGLMALTLSPYYKRYISWCLWWLQYFLTRVAICGKYLFNWAVRTKLKLTPIAAAGR
LDLSIAYFSMVGNWAKVLVVLLLFAGVDAETHVTRLARGSSPPSMASSSASQLSAPSLKATCTANGLVSFLVFFCFAWYLKGRWVPGAVYALYGMQLPC
EPEPDVAVLTSMLTDPSHITAEAAGRDSVTPIDTTIMAKNEVFCVQPEKGGRKPARYAAQGYKVLVLNPSVAATLGFGAYMSKAHGVRNSTGLYHVTN
DCPNSSIVYEAADAILHTSSYGFQYSPGQRVEFLVQAWKSKKTPMGFSDTAACGDIINGLPVSARRGREILLGPADGMSQLSAPSLKATCTANHDSPD
AELIEANLLWNPAIASLMAFTAAVTSPLTTSQTLLFNILGLVQAWKSKKTPMGFSYDTRCFDSTVTESDIDEREISVPAEILRKSRRFAQALPVWARP
DYMFAPTLWARMILMTHFPSVLIARDQLEQALSVIPTSGDVVVATDALMTGYTGDFDSVIDCHSKKKCDELAAKLVALGINAVAYYRGLDVVLPCSF
TTLPALSTGLIHLHQNIVDVQYLYKGRWVPGAVYALYGMWPLLLLLLLALPQRAYSPITYSTYGKFLADGGCSGGAYDIIICDECARSVRARLLARGCR
AAICGKYLFNWAVRTKKAVAHINSVWKDLLEDSVTPIDTTIMAKNEBFTPSPVVVGTTDRSGAPTYSWGANDTDVFVPGCVPCVREGNASRCWVAMTPT
VATRDGKLQDCTMLVCGDDLVVICESAGVQEDAASLRAVAGALVAPKIMSGEVPSTEDLVNLLPAILSYDTRCFDSTVTESDIRTEEAIYQCCDLDPQ
ELTPAETTVRLRAYMNTPGLPVCQDHLEFWPQPEYDLELITSCSSNVSVAHDGAGKRVVYLGKVIDTLTCGFADLMGYIPLVGAPLGGAAAIPLEVIK
GGRHLIFCHSKKKCDELAAKLVGGVLAALAAYCLSTGCVVIVGRIVLSGKPACESAGVQEDAASLRAFTEAMTRYSAPPGDPGWFTAGYSGGDIYHSV
SHARPRWFWFCLLLSSSTSGITGDNTTTSSEPAPSGCPPDSDAERTQRRGRTGRGKPGIYRFVAPGERPSGMFDVRMYVGGVEHRLEAACNWTRGERC
DLEDRDEAQLHVWVPPLNVRGGRDAVILLMCVVHPTLGVRATRKTSERSQPRGRRQPIPKARRPEGNVSVAHDGAGKRVVYLTRDPTTPLARAAWESE
PAPSGCPPDSDAESYSSMPPLEGEPGDPIGGHYVQMAIIKLGALTGTYVYNHLTPLRDPSTEDLVNLLPAILSPGALVVGVVCAAILRILDMIAGAHW
GVLAGIAYFSMVGNWAKVLVEGCGWAGWLLSPRGSRPSWGPTDPRRRSRNWTTQGCNCSIYPGHITGHRMAWDMMMNWSPWVAMTPTVATRDGKLPAT
QLRRHIDLLVGSRLWHYPCTINYTIPKVRMYVGGVEHRLEAAVFCVQPEKGGRKPARLIVFPDLGVRVCEKMMGYIPLVGAPLGGAARALAHGVRVLE
DGVNGGNAGRTTSGLVSLLTPGAKQNIQLINTNGLALLSCLTVPASAYQVRNSTGLYHVTNDCPGRDKNQVEGEVQIVSTAAQTFLATCINGVCPATQ
LRRHIDLLVGSATLCSALYVGDLCGSHAPTGSGKSTKVPAAYAAQGYKVLVLNPSVRTWAQPGYPWPLYGNEGCGWAGWLLSPRGSTEDVVCCSMSYS
WTGALVTPCAAEEQKLPIALDTEVAASCGGVVLVGLMALTLSPYYKRYWMNSTGFTKVCGAPPCVIGGAGNNTLHCPTSVEEACSLTPPHSAKSKFGY
GAKDVRCHARISGIQYLAGLSTLPGNPAIASLMAFTAAVTQIVGGVYLLPRRGPRLGVRATRKTSERSQPLHSYSPGEINRVAACLRKLGVPPLRAWR
HRTARHTPVNSWLGNIIMFAPTLWARMILMTHENLETTMRSPVFTDNSSPPAVPQSFQVAHLATPPGSVTVPHPNIEEVALSTTGEIPFYGKLVFDIT
KLLLAVFGPLWILQASLLKVPYFVTAALVMAQLLRIPQAILDMIAGAHWGVLAGCNTCVTQTVDFSLDPTFTIETTTLPQDAVSHGPTPLLYRLGAVQ
NEVTLTHPVTKYIMTCARVAIKSLTERLYVGGPLTNSRGENCGYRRCVIGGAGNNTLHCPTDCFRKHPEATYSRCGTCGSSDLYLVITRHADVIPVRRR
GDSRGSLLNMWSGTFPINAYTTGPCTPLPAPNYTFALWHSDTATSILGIGTVLDQAETAGARLVVLATYVPESDAAARVTAILSSLTVTQLLRRLHQW
RPSWGPTDPRRRSRNLGKVIDTLTCGFADLGPDQRPYCWHYPPKPCGIVPAKSVCGPVYCEECSQHLPYIEQGMMLAEQFKQKALGLLQTYQATVCAR
AQAPPPSWDQMWKCLIRLKPTLCGIVPAKSVCGPVYCFTPSPVVVGTTDRSGSSLTVTQLLRRLHQWISSECTTPCSGSWLRDLSDGSWSTVSSEAGT
EDVVCCSMSYSWTGWDQMWKCLIRLKPTLHGPTPLLYRLGAVQNLAEQFKQKALGLLQTASRQAEVIAPAVQTNWQKLEVFWAKHMWNFISGIQYLAG
LSTLPGLIAFASRGNHVSPTHYVPESDAAARVTAILATLCSALYVGDLCGSVFLVGQLFTFSPRRHSSVLCECYDAGCAWYELTPAETTVRLRAYMGW
VAAQLAAPGAATAFVGAGLAGAAIGSVGSWHINSTALNCNESLNTGWLAGLFYQHKFNNALSNSLLRHHNLVYSTTSRSACQRQKKVTAAMSTNPKPQ
RKTKRNTNRRPQDVKFPGGGSQTKQSGENFPYLVAYQATVCARAQAPPPSAPTYSWGANDTDVFVLNNTRPPLGNWFGCTVPPPRKKRTVVLTESTLS
TAIAELATKSFGSTTSRSACQROKKVTFDRLQVLDSHYQDVLDQAETAGARLVVLATATPPGSVTVPHPNIEFHYVTGMTTDNLKCPCQVPSPEFFTE
LDGVLKLTPIAAAGRLDLSGWFTAGYSGGDIYHSASRQAEVIAPAVQTNWQKLEVFWAKHMWNFCRASGVLTTSCGNTLTCYIKARAACRAAGLFDRL
QVLDSHYQDVLKEVKAAASKVKANLLGPLTNSRGENCGYRRCRASGVLTTSCGNTLIMETRCHCGAEITGHVKNGTMRIVGPRTCREVSFRVGLHEYP
VGSQLPCEPEPDVAVLTSKEVKAAASKVKANLLSVEEACSLTPPHSAKSGRDAVILLMCVVHPTLVFDITKLLLAVFGPMLTDPSHITAEAAGRRLARG
SPPSMASSSASPRPISYLKGSSGGPLLCPAGHAVGIFRAADFDQGWGPISYANGSGPDQRPYCWHYPPKPRHVGPGEGAVQWMNRLIAFASRGNHVSP
THCLWMMLLISQAEAALENLVILNAASLAGTHIIPDREVLYREFDEMEECSQHLPYIEQGMMLIHLHQNIVDVQYLYGVGSSIASWAIKWEYVSHARP
RWFWFCLLLLAAGVGIYLLPNRAAAATLGFGAYMSKAHGIDPNIRTGVRTITTGRVQGLLRICALARKMIGGHYVQMAIIKLGARRFAQALPVWARPD
YNPPLVETWKKPDYEPTAAQTFLATCINGVCWTVVHGAGTRTIASPWAHNGLRDLAVAVEPVVFSQMETKLITWGAKGPVIQMYTNVDQDLVGWPAPQ
GSRSLTPCKVVILDSFDPLVAEEDEREISVPAEILRKSLTGTYVVNHLTPLRDWAHNGLRDLAVAVEPVCTRGVAKAVDFIPVENLDTMRSPVFTDN
ALGINAVAYYRGLDVSVIPTSGDVVVVATDMSADLBVVTSTWVLVGGVLAALAAYCLSTGALMTGYTGDFDSVIDCNTCVTQTVDFSLDPNTNRRPQD
VKFPGGGQIVGGVYLLPRRGPRRALAHGVRVLEDGVNYATGNLPGCSFSIFLSKFGYGAKDVRCHARKAVAHINSVWKDLLETPGAKQNIQLINTNGS
WHINSTALNCNESLNTGWLAGLFYQHKFNSSGCPERLASCRRLTVVLLFLLLLADARVCSCLWMMLLISQABAALDCEIYGACYSIEPLDLPPIIQRLH
GLSAFSWTVYHGAGTRTIASPKGPVIQMYTNVDQDLYRFVAPGERPSGMFDSSVLCECYDAGCAWYRSELSPLLLLSTTQWQVLPCSFTTLPALSTGLR
KLGVPPLRAWRHRARSVRARLLARGGRASPLTTSQTLLFNILGGWVAAQLAAPGAATALWILQASLLKVPYFVRVQGLLRICALARKMVKNGTMRIVG
PRTCRNMWSGTPFINAYTTGEVALSTTGEIPFYGKAIPLEVIKGGRHLIFLTRDPTTPLARAAWETARHTPVNSWLGNIIRVSAEEYVEIRRVGDFHY
VTGMTTDNLKCPPVVHGCPLPPPRSPPVPPRRKKRTVVLTESTLSTALAELATKSFGSSSTSGITGDNTTTSVSCQRGYKGVWRGDGIMHTRCHCGAE
ITGHVFLVGQLFTFSPRRHWTTQGCNCSIYPGHIFVGAGLAGAAIGSVGLGKVLVDILAGYGAGDIWDWICEVLSDFKTWLKAKLMPQLPGIPFNSSI
VYEAADAILHTPGCVPCVREGNASRCSSGCPERLASCRRLTDFDQGWGPISYANGSRTEEAIYQCCDLDPQARVAIKSLTERLYVGVSKGWRLLAPIT
AYAQQTRGLLGCIITSLTFFSVLIARDQLEQALDCEIYGACYSIEPLDCQVPSPEFFTELDGVRLHRFAPPCKPLLRETCYIKARAACRAAGLQDCTM
```

Figure 26 (Cont)

LVCGDDLVVIIDPNIRTGVRTITTGSPITYSTYGKFLADGCNWTRGERCDLEDRDRSELSPLLLSTTQWQTGHRMAWDMMMNWSPTAALVMAQLLRIP
QAPGALVVGVVCAAILRRHVGPGEGAVQWMNRHDSPDAELIEANLLWRQEMGGNITRVESENEGVFTGLTHIDAHFLSQTKQSGENFPYLVARGRRQP
IPKARRPEGRTWAQPGYPWPLYGNLIVFPDLGVRVCEKMALYDVVSKLPLAVMGYATGNLPGCSFSIFLLALLSCLTVPASAYQLGKVLVDILAGYGA
GVAGALVAFKIMSGEVSYSSMPPLEGEPGDPDLSDGSWSTVSSEAGRQEMGGNITRVESENKVVILDSFDPLVAEEVGWPAPQGSRSLTPCTCGSSDL
YLVTRHADGCSGGAYDIIICDECHSTDATSILGIGTVLTFTIETTTLPQDAVSRTQRRGRTGRGKPGIDCFRKHPEATYSRCGSGPWITPRCLVDYPY
LAAGVGIYLLPNRAAALVTPCAABEQKLPINALSNSLLRHHNLVYISSECTTPCSGSWLRDIWDWICEVLSDFKTWLKAKLMPQLPGIPFVSCQRGYK
GVWRGDGSGPWITPRCLVDYPYRLWHYPCTINYTIFK

Artificial DNA:
----------------
GTGATTCCCGTCAGGAGAAGGGGAGACTCCAGGGGAAGCCTCCTGTCCCCAGACCCATTAGCTATCTGAAAGGCTCCAGCGGAGGCCCTGCCAGAAG
GGGAAGGGAAATCCTCCTGGGACCCGCTGACGGAATGGTCAGCAAAGGCTGGAGGCTCCTGGCTCCCATTACCGCTTACGTAGGCTCCACAGATTCG
CTCCCCCTTGCAAACCCCTCCTGAGAGAGGAAGTGTCCTTCAGAGTGGGACTGCATGAGTATCCCGTCGGCTCCGTGGTCTTCTCCCAGATGGAGACA
AAGCTCATCACATGGGGAGCCGATACCGCTGCCTGTGGCGATATCATTAACGGACTGCCTGTGTCCCTGCTCTGCCCTGCCGGACACGCTGTGGGAAT
CTTTAGGGCTGCCGTCTGCACAAGGGGAGTGGCTAAGGCTGTGGATTTCATTCCCGTCGCTGCTGTGATTGTGGGAAGGATTGTGCTCAGCGGAAAGC
CTGCCATTATCCCTGACAGAGAGGTCCTGTATAGGGAATTCGATGAGATGCCCTGTACCCCTCTGCCTGCCCCTAACTATACCTTTGCCCTCTGGAGA
GTGTCCGCCGAAGAGTATGTGGAAATCAGAAGGGTCGGCGATGCCCTCTACGATGTGGTCAGCAAACTGCCTCTGGCTGTGATGGGCTCCAGCTATGG
CTTTCAGTATAGCCCTGGCCAAAGGGTCGAGTTTATCTCCTGGTGTCTGTGGTGGCTCCAGTATTTCCTCACCAGAGTGGAAGCCCAACTGCATGTGT
GGGTGCCTCCCCTCAACGTCAGGGGAGAGAATCTGGTCATCCTCAACGCTGCCTCCCTGGCTGGCACACACGGACTGGTCAGCTTTCTGGTCTTCTTT
TGCTTTGCCTGGTACCTCCTGCCTCCCATTATCCAAAGGCTCCACGGACTGTCCGCCTTTAGCCTCCACTCCTACTCCCCGGAGAGATTAACAGAGT
GGCTGCCTGTAACCCTCCCCTCGTGGAAACCTGGAAGAAACCCGATTACGAACCCCCTGTGGTCCACGGATGCCCTCTGCCTCCCCCTAGGTCCCCCC
CTGGCGTCGGCTCCAGCATTGCCTCCTGGGCTATCAAATGGGAATACGTCGTGCTCCTGTTTCTGCTCCTGGCTGACGTAGGGTCTGCTCCCTGAAT
AACACAAGGCCTCCCCTCGGCAATTGGTTTGGCTGTACCTGGATGAATAGCACAGGCTTTACCAAAGTGTGTGGCGCTCCCCCTTTCACAGAGGCTAT
GACAAGGTATAGCGCTCCCCCTGGCGATCCCCTCAGCCTGAGTATGACCTCGAGCTCATCACAAGCTGTAGCTCCTGGCCTCTGCTCCTGCTCCTGC
TCGCCCTCCCCCAAAGGGCTTACGCTCTGGATACCGAAGTGGCTGCCTCCTGCGGAGGCGTCGTGCTCCAGCAAACCAGAGGCCTCCTGGGATGCATT
ATCACAAGCCTCACCGGAAGGGATAAGAATCAGGTCGAGGGAGAGGTCCAGATTGTGTCCAGCTCCCCCCCTGCCGTCCCCCAAAGCTTTCAGGTCGC
CCATCTGCATGCCCCTACCGGAAGCGGAAAGTCCACCAAAGTGCCTGCCGTCAACACACCCGGACTGCCTGTGTGTCAGGATCACCTCGAGTTTTGGG
AAGGCGTCTTCACAGGCCTCACCCATATCGATGCCCATTTCCTCGTGCTCCTGCTCTTCGCTGGCGTCGACGGTGAGACACACGTCACCGGAGGCAAT
GCCGGAAGGACAACCTCCGGCCTCGTGTCCCTGCTCGAGGTCACCCTCACCCATCCCGTCACCAAATACATTATGACATGCATGAGCGCTGACCTCGA
GGTCGTGACAAGCACATGGGTCCTGGTCGTGGGACTGATGGCCCTCACCCTCAGCCCTTACTATAAGAGATACATTAGCTGGTGCCTCTGGTGGCTGC
AATACTTTCTGACAAGGGTCGCCATTTGCGGAAAGTATCTGTTTAACCTGGGCCGTCAGGACAAAGCTCAAGCTCACCCCTATCGCTGCCGCTGGCAGA
CTGGATCTGTCCATCGCTTACTTTAGCATGGTGGGAAACTGGGCCAAAGTGCTCGTGGTCCTGCTCCTGTTTGCCGGAGTGGATGCCGAAACCCATGT
GACAAGGCTCGCCAGAGGCTCCCCCCCTAGCATGGCCTCCAGCTCCGCCTCCCAGCTCAGCGCTCCCTCCCTGAAAGCCACATGCACAGCCAATGGCC
TCGTGTCCTTCCTCGTGTTTTTCTGTTTCGCTTGGTATCTGAAAGGCAGATGGGTCCCCGGAGCCGTCTACGCTCTGTATGGCATGCAGCTCCCCTGT
GAGCCTGAGCCTGACGTCGCCGTCCTGACAAGCATGCTGACAGACCCTAGCCATATCACAGCCGAAGCCGCTGGCAGAGACTCCGTGACACCCATTGA
CACAACCATTATGGCTAAGAATGAGGTCTTCTGTGTGCAACCCGAAAAGGGAGGCAGAAAGCCTGCCAGATACGCTGCCCAAGGCTATAAGGTCCTGG
TCCTGAATCCCTCCGTGGCTGCCACACTGGGATTCGGAGCCTATATGTCCAAGGCTCACGGAGTGAGAAACTCCACCGGACTGTATCACGTCACCAAT
GACTGTCCCAATAGCTCCATCGTCTACGAAGCCGCTGACGCTATCCTCACCAAGCTCCTACGGATTCCAATACTCCCCCGGACAGAAGTGGAATT
CCTCGTGCAAGCCTGGAAGTCCAAGAAAACCCCTATGGGATTCTCCGACACAGCCGCTTGCGGAGACATTATCAATGGCCTCCCCGTCAGCGCTAGGA
GAGGCAGAGAGATTCTGCTCGGCCCTGCCGATGGCATGAGCCAACTGTCCGCCCCTAGCCTCAAGGCTACCTGTACCGCTAACCATGACTCCCCCGAT
GCCGAACTGATTGAGGCTAACCTCCTGTGGAACCCTGCCATTGCCTCCCTGATGGCCTTTACCGCTGCCGTCACCTCCCCCCTCACCACAAGCCAAAC
CCTCCTGTTTAACATTCTGGGACTTGGCTCCAGGCTTGGAAAAGCAAAACACCATGGGCTTAGCTATGACACAAGGTGTTTCGATAGCACAGTGA
CAGAGTCCGACATTGACGAAAGGGAAATCTCCGTGCCTGCCGAAATCCTCAGGAAAAGCAGAAGGTTTGCCCAAGCCCTCCCCGTCTGGGCTAGGCCT
GACTATATGTTTGCCCCTACCCTCTGGGCTAGGATGATCCTCATGACACACTTTTTCTCCGTGCTCATCGCTAGGGATCAGCTCGAGCAAGCCCTCAG
CGTCATCCCTACCTCCGGCCGATGTGGTCGTGGTCGCCACAGACGCTCTGATGACCGGATACACAGGCGATTTCGATAGCGTCATCGATTGCCATAGCA
AAAAGAAATGCGATGAGCTCGCCGCTAAGCTCGTGGCTCTGGGAATCAATGCCGTCGCCTATTACAGAGGCCTCGACGTCGTGCTCCCCCTGTAGCTTT
ACCACACTGCCTGCCCTCAGCACAGGCCTCATCCATCTGCATCAGAATATCGTCGACGTCCAGTATCTGTATAAGGGAAGGTGGGTGCCTGGCGCTGT
GTATGCCCTCTACGGAATGTGGCCCCTCCTGCTCCTGCTCCTGGCTCTGCCTCAGAGAGCCTATAGCCCTATCACATACTCCACCTATGGCAAATTCC
TCGCCGATGGCGGATGCTCCGGCGGAGCCTATGACATTATCATTTGCGATGAGTGTGCCAGAAGCGTCAGGGCTAGGCTCCTGGCTAGGGGAGGCAGA
GCCGCTATCTGTGGCAAATACCTCTTCAATTGGGCTGTGAGAACCAAAAAGGCTGTGGCTCACATTAACTCCGTGTGAAGGATCTGCTCGAGGATAG
CGTCACCCCTATCGATACCACAATCATGGCCAAAAACGAATTCACACCCTCCCCCGTCGTGGTCGGCACAACCGATAGGTCCGGCGCTCCCCACATACT
CCTGGGGAGCCAATGACACAGACGTCTTCGTCCCCGGATGCGTCCCCTGTGTGAGAGAGGGAAACGCTAGCAGATGCTGGGTGGCTATGACACCCACA
GTGGCTACCAGAGACGGAAAGCTCCAGGATTGCACAATGCTCGTGTGTGGCGATGACCTCGTGGTGCATCTGTGAGTCCGCCGGAGTGCAAGAGGATGC
CGCTAGCCTCAGGGCTGTGGCTGGCGCTCTGGTCGCCTTTAAGATTATGTCCGGCGAAGTGCCTAGCACAGAGGATTCTGGTCAACCTCCTGCCTGCCA
TTCTGTCCTACGATACCAGATGCTTTGACTCCACCGTCACCGAAAGCGATATCAGAACCGAAGAGGCTATCTATCAGTGTTGCGATCTGGATCCCCAA
GAGCTCACCCCTGCCGAAACCACAGTGAGACTGAGAGCCTATATGAATACCCCTGGCCTCCCCGTCTGCCAAGACCATCTGGAATTCTGGCCCAACC
CGAATACGATCTGGAACTGATTACCTCCTGCTCCAGCAATGTGTCCGTGGCTCACGATGGCGCTGGCAAAAGGGCTACTATCTGGGAAAGGTCATCG
ATACCCTCACCTGTGGCTTTGCCGATCTGATGGGCTATATCCCTCTGGTCGGCGCTCCCCTCGGCGGAGCCGCTGCCATTCCCCTCGAGGTCATCAAA
GGCGGAAGGCATCTGATTTTCTGTCACTCCAAGAAAAGTGTGACGAACTGGCTGCCAAACTGGTCGGCGGAGTGCTCGCCGCTCTGGCTGCCTATTG
CCTCAGCACAGGCTGTGTGGTCATCGTCGGCAGAATCGTCCTGTCCGGCAAACCCGCTTGCGAAAGCGCTGGCGTCCAGGAAGACGCTGCCTCCCTGA
GAGCCTTTACCGAAGCCATGACCAGATACTCCGCCCCTCCCGGAGACCCTGGCTGGTTCACAGCCGGATACTCCGGCGAGACATTTACCATAGCGTC
AGCCATGCCAGACCCAGATGGTTTTGGTTTTGCCTCCTGCTCAGCTCCAGCACAGGGAATCACAGGCGATAACACAACCACAAGCTCCGAGCCTGC
CCCTAGCGGATGCCCTCCCGATAGCGATGCCGAAAGGACACAGAGAAGGGGAAGGACAGGCAGAGGCAAACCCGGAATCTATAGGTTTGTGGCTCCG
GAGAGAGACCCTCCGGCATGTTCGATGTGAGAATGTATGTGGGAGGCGTCGAGCATAGGCTCGAGGCTGCCTGTAACTGGACCAGAGGCGAAAGGTGT
GACCTCGAGGATAGGGATGAGGCTCAGCTCCACGTCTGGGTCCCCCCTCTGAATGTGAGAGGCGGAAGGGATGCCGTCATCCTCCTGATGTGCGTCGT
GCATCCCACACTGGGAGTGAGAGCCACAAGGAAAACCTCCGAGAGAAGCCAACCCAGAGGCAGAAGGCAACCCATTCCCAAAGCCAGAAGGCCTGAGG
GAAACGTCAGCGTCGCCCATGACGGAGCCGGAAAGAGAGTGTATTACCTCACCAGAGACCCTACCACACCCCTCGCCAGACCGCTTGGGAAAGCGAA
CCCGCTCCCTCCGGCTGTCCCCCTGACTCCGACGCTGAGTCCTACTCCAGCATGCCCCCTCTGAAAGGCGAACCCGGAGACCCTATCGGAGGCCATTA
CGTCCAGATGGCATTATCAAACTGGGAGCCCTCACCGGAACCTATGTGATTAACCATCTGACACCCCTCAGGGATCCCTCCACCGAAGACCTCGTGA
ATCTGCTCCCCGCTATCCTCAGCCCTCGGCGCTCTGGTCGGTCGGTCTGCGCTGCCATTCTGAGAATCCTCGACATGATCGCTGGCGCTCACTGG
GGCGTCCTGGCTGGCATTGCCTATTTCTCCATGCTCGGCAATTGGGCTAAGGTCCTGGTCGAGGGATGCGGATGGGCTGGCTGGCTGCTCAGCCCTAG
GGGAAGCAGACCCTCCTGGGGACCCACAGACCCTAGGAGAAGGTCCAGGAATTGGACAACCCAAGGCTGTAACTGTAGCATTTACCCTGGCCATATCA
CAGGCCATAGGATGGCCTGGGACATGATGATGAACTGGAGCCCTTGGGTCGCCATGACCCCTACCGTCGCCACAAGGGATGGCAAACTGCCTGCCACA

Figure 26 (Cont)

```
CAGCTCAGGAGACACATTGACCTCCTGGTCGGCTCCAGGCTCTGGCATTACCCTTGCACAATCAATTACACAATCTTTAAGGTCAGGATGTACGTCGG
CGGAGTGGAACACAGACTGGAAGCCGCTGTGTTTTGCGTCCAGCCTGAGAAAGGCGGAAGGAAACCCGCTAGGCTCATCGTCTTCCCTGACCTCGGCG
TCAGGGTCTGCGAAAAGATGATGGGATACATTCCCCTCGTGGGAGCCCCTCTGGGAGGCGCTGCCAGAGCCCTCGCCCATGGCGTCAGGGTCCTGGAA
GACGGAGTGAATGGCGGAAACGCTGGCAGAACCACAAGCGGACTGGTCAGCCTCCTGACACCCGGAGCCAAACAGAATATCCAACTGATTAACACAAA
CGGACTGGCTCTGCTCAGCTGTCTGACAGTGCCTGCCTCCGCCTATCAGGTCAGGAATAGCACAGGCCTCTACCATGTGACAAACGATTGCCCTGGCA
GAGACAAAAACCAAGTGGAAGGCGAAGTGCAAATCGTCAGCACAGCCGTCAGACATTCCTCGCCACATGCATTAACGGAGTGTGTCCCGCTACCCAA
CTGAGAAGGCATATCGATCTGCTCGTGGGAAGCGCTACCCTCTGCTCCGCCCTCTACGTCGGCGATCTGTGTGGCTCCCACGCTCCCACAGGCTCCGG
CAAAAGCACAAAGGTCCCCGCTGCCTATGCCGCTCAGGGATACAAAGTGCTCGTGCTCAACCCTAGCGTCAGGACATGGGCTCAGCCTGCTATCCCT
GGCCCCTCTACGGAAACGAAGGCTGTGGCTGGGCCGGATGGCTCCTGTCCCCAGAGGCTCCACCGAAGACGTCGTGTGTTGCTCCATGTCCTACTCC
TGGACAGGCGCTCTGGTCACCCCTTGCGCTGCCGAAGAGCAAAAGCTCCCCATTGCCCTCGACACAGAGGTCGCCGCTAGCTGTGGCGGAGTGGTCCT
GGTCGGCCTCATGGCTCTGACACTGTCCCCCTATTACAAAAGGTATTGGATGAACTCCACCGGATTCACAAAGGTCTGCGGAGCCCCTCCCTGTGTGA
TTGGCGGAGGCCGGAAACAATACCCTCCACTGTCCCCACAAGCGTCGAGGAGCCGTAGCCTCACCCCTCCCCATAGCGCTAAGTCCAAGTTTGGCTAT
GGCGCTAAGGATGTGAGATGCCATGCCAGAATCTCCGGCATTCAGTATCTGGCTGGCCTCAGCACACTGCCTGGCAATCCCGCTATCGCTAGCCTCAT
GGCTTTCACAGCCGCTGTGACACAGATTGTGGGAGGCGTCTACCTCCTGCCTAGGAGAGGCCCTAGGCTCGGCGTCAGGGCTACCAGAAAGACAAGCG
AAAGGTCCCAGCCTCTGCATAGCTATAGCCCTGGCGAAATCAATAGGGTCGCCGCTTGCCTCAGGAAACTGGGAGTGCCTCCCCTCAGGGCTTGGAGA
CACAGAACCGCTAGGCATACCCCTGTGAATAGCTGGCTGGGAAACATTATCATGTTCGCTCCCACACTGTGGGCCAGAATGATTCTGATGACCCATGA
GAATCTGGAAACCACAATGAGAAGCCCTGTGTTTACCGATAACTCCAGCCCTCCCGCTGTGCCTCAGTCCTTCCAAGTGGCTCACCTCGCCACACCCC
CTGGCTCCGTGACAGTGCCTCACCCTAACATTGAGGAAGTGGCTCTGTCCACCACAGGCGAAATCCCTTTCTATGGCAAACTGGTCTTCGATATCACA
AAGCTCCTGCTCGCCGTCTTCGGACCCCTCTGGATTCTGCAAGCCTCCCTGCTCAAGGTCCCCTATTTCGTCACCGCTGCCCTCGTGATGGCCCAACT
GCTCAGGATTCCCCAAGCCATTCTGGATATGATTGCCGGAGCCCATTGGGGAGTGCTCGCCGGATGCAATACCTGTGTGACACAGACAGTGGATTTCT
CCCTGGATCCCACATTCACAATCGAAACCACAACCCTCCCCCAAGACGCTGTGTCCCACGGACCCACACCCCTCCTGTATAGGCTCGGCGCTGTGCAA
AACGAAGTGACACTGACACACCCTGTGACAAAGTATATCATGACCTGTGCCAGAGTGGCTATCAAAAGCCTCACCGAAAGGCTCTACGTCGGCGGACC
CCTCACCAATAGCAGAGGCGAAAACTGTGGCTATAGGAGATGCGTCATCGGAGGCGCTGGCAATAACACACTGCATTGCCCTACCGATTGCTTTAGGA
AACACCCTGAGGCTACCTATAGCAGATGCGGAACCTGTGGCTCCAGCGATCTGTATCTGGTCACCAGACACGCTGACGTCATCCCTGTGAGAAGGAGA
GGCGATAGCAGAGGCTCCCTGCTCAACATGTGGTCCGGCACATTCCCTATCAATGCCTATACCACAGGCCCTTGCACACCCCTCCCCGCTCCCAATTA
CACATTCGCTCTGTGGCACTCCACCGATGCCACAAGCATTCTGGGAATCGGAACCGTCCTGGATCAGGCTGAGACAGCCGGAGCCAGACTGGTCGTGC
TCGCCACATACGTCCCCGAAAGCGATGCCGCTGCCAGAGTGACAGCCATTCTGTCCAGCCTCACCGTCACCCAACTGCTCAGGAGACTGCATCAGTGG
AGGCCTAGCTGGGGCCCTACCGATCCCAGAAGGAGAAGCAGAAACCTCGGCAAAGTGATTGACACACTGACATGCGGATTCGCTGACCTCGGCCCTGA
CCAAAGGCCTTACTGTTGGCATTACCCTCCCAAACCCTGTGGCATTGTGCCTGCCAAAAGCGTCTGCGGACCCGTCTACTGTGAGGAATGCTCCCAGC
ATCTGCCTTACATTGAGCAAGGCATGATGCTCGCCGAACAGTTTAAGCAAAAGGCTCTGGGACTGCTCCAGACATACCAAGCCACAGTGTGTGCCAGA
GCCCAAGCCCCTCCCCCTAGCTGGGACCAAATGTGGAAGTGTCTGATTAGGCTCAAGCCTACCCCTCTGCGGAATCGTCCCCGCTAAGTCCGTGTGTGG
CCCTGTGTATTGCTTTACCCCTAGCCCTGTGGTCGTGGGAACCACAGACAGAAGCGGAAGCTCCCTGACAGTGACACAGCTCCTGAGAAGGCTCCACC
AATGGATTAGCTCCGAGTGTACCACACCCTGTAGCGGAAGCTGGCTGAGAGACCTCAGCGATGGCTCCTGGTCCACCGTCAGCTCCGAGGCTGGCACA
GAGGATGTGGTCTGCTGTAGCATGAGCTATAGCTGGACCGGATGGGATCAGATGTGGAAATGCCTCATCAGACTGAAACCCACACTGCATGGCCCTAC
CCCTCTGCTCTACAGACTGGGAGCCGTCCAGAATCTGGCTGAGCAATTCAAACAGAAAGCCCTCGGCCTCCTGCAAACCGCTAGCAGACAGGCTGAGG
TCATCGCTCCCGCTGTGCAAACCAATTGGCAAAAGCTCGAGGTCTTCTGGGCCAAACACATGTGGAATTTCATTAGCGGAATCCAATACCTCGCCGGA
CTGTCCACCCTCCCCGGACTGATTGCCTTTGCCTCCAGGGGAAACCATGTGTCCCACACACTATGTGCCTGAGTCCGACGCTGCCGCTAGGGTCAC
CGCTATCCTCGCCACACTGTGTAGCGCTCTGTATGTGGGAGACCTCTGCGGAAGCGTCTTCCTCGTGGGACAGCTCTTCACATTCTCCCCCAGAAGGC
ATAGCTCCGTGCTCTGCCAATGCTATCACCCTCGCTGTGCCCTGGTACCAACTGACACCCGCTGAGACAACCGTCAGGCTCAGGGCTTACATGGGCTGG
GTGGCTGCCCAACTGGCTGCCCCTGGCGCTGCCACAGCCTTTGTGGGAGCCGGACTGGCTGGCGCTGCCATTGGCTCCGTGGGAAGCTGGCACATTAA
CTCCACCGCTCTGAATTGCAATGAGTCCCTGAATACCGGATGGCTCGCCGGACTGTTTTACCAACACAAATTCAATAACGCTCTGTCCAACTCCCTGC
TCAGGCATCACAATCTGGTCTACTCCACCACAAGCAGAAGCGCTCGCCAAAGGCAAAAGAAAGTGACAGCCGCTATGTCCACCAATCCCAAACCCAA
AGGAAAACCAAAAGGAATACCAATAGGAGACCCCAAGACGTCAAGTTTCCCGGAGGCGGAAGCCAAACCAAACAGTCCGGCGAAAACTTTCCCTATCT
GGTCGCCTATCAGGCTACCGTCTGCGCTAGGGCTCAGGCTCCCCCTCCCTCCGCCCCTACCTATAGCTGGGGCGCTAACGATACCGATGTGTTTGTGC
TCAACAATACCAGACCCCCTCTGGGAAATGGTTCGGATGCACAGTGCCTCCCCCTAGGAAAAAGAGAACCGTCGTGCTCACCGAAAGCACACTGTCC
ACCGCTCTGGCTGAGCTCGCCACAAAGTCCTTCGGAAGCACAACCTCCAGGTCCGCCTGTCAGAGACAGAAAAAGGTCACCTTTGACAGACTGCAAGT
GCTCGACTCCCACTATCAGGATGTGCTCGACCAAGCCGAAACCGCTGGCGCTAGGCTCGTGGTCCTGGCTACCGCTACCCCTCCCGGAAGCGTCACCG
TCCCCCATCCCAATATCGAATTCCATTACGTCACCGGAATGACAACCGATAACCTCAAGTGTCCCTGTCAGGTCCCCTCCCCGAATTCTTTACCGAA
CTGGATGGCGTCCTGAAACTGACACCCATTGCCGCTGCCGGAAGGCTCGACCTCAGCCGATGGTTTACCGCTGGCTATAGCGGAGGCGATATCTATCA
CTCCGCCTCCAGGCAAGCCGAAGTGATTGCCCCTGCCGTCCAGACAAACTGGCAGAAACTGGAAGTGTTTTGGGCTAAGCATATGTGGAACTTTTGCA
GAGCCTCCGGCGTCCTGACAACCTCCTGCGGAAACACACTGACATGCTATATCAAAGCCAGACCCTGCTTGCAGAGCCGCTGGCCTCTTCGATAGGCTC
CAGGTCCTGGATAGCCATTACCAAGCAGCGTCCTGAAAGAGGTCAAGGCTGCCGCTAGCAAAGTGAAAGCCAATCTGCTCGGCCCTCTGACAAACTCCAG
GGGAGAGAATTGCGGATACAGAAGGTGTAGGGCTAGCGGAGTGCTCACCACAAGCTGTGGCAATACCCTCATCATGCACACAAGGTGTCACTGTGGCG
CTGAGATTACCGGACACGTCAAGAATGGCACAATGAGAATCGTCGGCCCTAGGACATGCAGAGAGGTCAGCTTTAGGGTCGGCCTCCACGAATACCCT
GTGGGAAGCCAACTGCCTTGCGAACCCGAACCCGATGTGGCTGTGCTCACCTCCAAGGAAGTGAAAGCCGCTGCCTCCAAGGTCAAGGCTAACCTCCT
GTCCGTGGAAGAGGCTTGCTCCCTGCACACCCCCTCACTCCGCCAAAGGCAGAGACGCTGTGATTCTGCTCATGTGTGTGGTCCACCCTACCCTCGTGT
TTGACATTACCAAACTGCTCCTGGCTGTGTTTGGCCCTATGCTCACCGATCCCTCCCACATTACCGCTGAGGCTGCCGGAAGGAGACTGGCTAGGGGA
AGCCCTCCCTCCATGGCTAGCTCCAGCGCTAGCCCTAGGCCTATCTCCTACCTCAAGGGAAGCTCCGGCGGACCCCTCCTGTGTCCCGCTGGCCATGC
CGTCGGCATTTTCAGAGCCGCTGACTTTGACCAAGGCTGGGGCCCTATCTCCTACGCTAACGGAAGCGGACCCGATCAGACCTATTGCTGGCACT
ATCCCCCTAAGCCTAGGCATGTGGGACCCGGAGAGGGACCGTCCAGTGGATGAATAGGCTCATCGCTTTCGCTAGCAGAGGCAATCACGTCAGCCCT
ACCCATTGCCTCTGGATGATGCTCCTGATTAGCCAAGCCGAAGCCGCTCTGGAAAACCTCGTGATTCTGAATGCCGCTAGCCTCGCCGGAACCCATAT
CATTCCCGATAGGGAAGTGCTCTACAGAGAGTTTGACGAAATGGAAGAGTGTAGCCAACACCTCCCCTATATCGAACAGGGAATGATGCTGATTCACC
TCCACCAAAACATTGTGGATGTGCAATACCTCTACGGAGTGGGAAGCTCCATCGTCGCTAGCTGGGCCATTAAGTGGGAGTATGTGTCCCACGCTAGGCCT
AGGTGGTTCTGGTTCTGTCTGCTCCTGCTCGCCGCTGGCGTCGGCATTTACCTCCTGCCTAACAGAGCCGCTGCCGCTACCCCTCGGCTTTGGCGCTTA
CATGAGCAAAGCCCATGGCATTGACCCTAACATTAGGACAGGCGTCAGGACAATCACAACCGGAAGGGTCCAGGGACTGCTCAGGATTTGCGCTCTGG
CTAGGAAAATGATTGCCGACACTATGTGCAAATGGCTATCATTAAGCTCGGCGCTAGGAGATTCGGCTCAGGCTCTGCCTGTGTGGGCCAGACCCGAT
TACAATCCCCCTCTGGTCGAGACATGGAAAAAGCCTGACTATGAGCGTACCGCTGCCCAAACCTTTCTGGCTACCTGTATCAATGGCGTCTGCTGGAC
CGTCTACCATGGCGCTGGCACAAGGACAATCGCTAGCCCTTGGGCTCACAATGGCCTCAGGGATCTGGCTGTGGCTGTGGAACCCGTCGTGTTTAGCC
AAATGGAAACCAAACTGATTACCTGGGGCGCTAAGGGACCCGTCATCCAAATGTATACCAATGTGGATCAGGATCTGGTCGGCTGGCCGCTCCCCAA
GGCTCCAGGTCCCTGACACCCTGTAAGGTCGTGATTCTGGATAGCTTTGACCCTCTGGTCGCCGAAGAGGATGAGAGAGATTAGCGTCCCCGCTGA
GATTCTGAGAAAGTCCCTGACAGGCACATACGTCTACAATCACCTCACCCCTCTGAGAGACTGGGCCCATAACGGACTGAGAGACCTCGCCGTCGCCG
TCGAGCCTGTGTGTACCAGAGGCGTCGCCAAAGCCGTCGACTTTATCCCTGTGGAAAACCTCGAGACAACCATGAGGTCCCCGTCTTCACAGACAAT
GCCCTCGGCATTAACGCTGTGGCTTACTATAGGGGACTGGATGTGTCCGTGATTCCCACAAGCGGAGACGTCGTGGTCGTGGCTACCGATATGTCCGC
```

Figure 26 (Cont)

```
CGATCTGGAAGTGGTCACCTCCACCTGGGTGCTCGTGGGAGGCGTCCTGGCTGCCCTCGCCGCTTACTGTCTGTCCACCGGAGCCCTCATGACAGGCT
ATACCGGAGACTTTGACTCCGTGATTGACTGTAACACATGCGTCACCCAAACCGTCGACTTTAGCCTCGACCCTAACACAAACAGAAGGCCTCAGGAT
GTGAAATTCCCTGGCGGAGGCCAAATCGTCGGCGGAGTGTATCTGCTCCCCAGAAGGGGACCCAGAAGGGCTCTGGCTCACGGAGTGAGAGTGCTCGA
GGATGGCGTCAACTATGCCACAGGCAATCTGCCTGGCTGTAGCTTTAGCATTTTCCTCAGCAAATTCGGATACGGAGCCAAAGACGTCAGGTGTCACG
CTAGGAAAGCCGTCGCCCATATCAATAGCGTCTGGAAAGACCTCCTGGAAACCCCTGGCGCTAAGCAAAACATTCAGCTCATCAATACCAATGGCTCC
TGGCATATCAATAGCACAGCCCTCAACTGTAACGAAAGCCTCAACACAGGCTGGCTGGCTGGCCTCTTCTATCAGCATAAGTTTAACTCCAGCGGATG
CCCTGAGAGACTGGCTAGCTGTAGGAGACTGACAGTGGTCCTGCTCTTCCTCCTGCTCGCCGATGCCAGAGTGTGTAGCTGTCTGTGGATGATGCTGC
TCATCTCCCAGGCTGAGGCTGCCCTCGACTGTGAGATTTACGGAGCCTGTTACTCCATCGAACCCCTCGACCTCCCCCCTATCATTCAGAGACTGCAT
GGCCTCAGCGCTTTCTCCTGGACAGTGTATCACGGAGCCGGAACCAGAACCATTGCCTCCCCCAAAGGCCCTGTGATTCAGATGTACACAAACGTCGA
CCAAGACCTCTACAGATTCGTCGCCCCTGGCGAAAGGCCTAGCGGAATGTTTGACTCCAGCGTCCTGTGTGAGTGTTACGATGCCGGATGCGCTTGGT
ATAGGTCCGAGCTCAGCCCTCTGCTCCTGTCCACCACACAGTGGCAGGTCCTGCCCTTGCTCCTTCACAACCCTCCCCGCTCTGTCCACCGGACTGAGA
AAGCTCGGCGTCCCCCCTCTGAGAGCCTGGAGGCATAGGGCTAGGTCCGTGAGAGCCAGACTGCTCGCCAGAGGCGGAAGGGCTAGCCCTCTGACAAC
CTCCCAGACACTGCTCTTCAATATCCTCGGCGGATGGGTCGCCGCTCAGCTCGCCGCTCCCGGAGCCGCTACCGCTCTGTGGATCCTCCAGGCTAGCC
TCCTGAAAGTGCCTTACTTTGTGAGAGTGCAAGGCCTCCTGGAGAATCTGTGCCTCGCCAGAAAGATGGTGAAAAACGGAACCATGAGGATTGTGGGA
CCCAGAACCTGTAGGAATATGTGGAGCGGAACCTTTCCCATTAACGCTTACACAACCGGAGAGGTCGCCCTCAGCACAACCGGAGAGATTCCCTTTTA
CGGAAAGGCTATCCCTCTGGAAGTGATTAAGGGAGGCAGACACCTCATCTTTCTGACAAGGGATCCCACAACCCCTCTGGCTAGGGCTGCCTGGGAGA
CAGCCAGACACACACCCGTCAACTCCTGGCTCGGCAATATCATTAGGGTCAGCGCTGAGGAATACGTCGAGATTAGGAGAGTGGGAGACTTTCACTAT
GTGACAGGCATGACCACAGACAATCTGAAATGCCCTCCCGTCGTGCATGGCTGTCCCCTCCCCCCTCCCAGAAGCCCTCCCGTCCCCCCTCCCAGAAA
GAAAAGGACAGTGGTCCTGACAGAGTCCACCCTCAGCACAGCCCTCGCCGAACTGGCTACCAAAAGCTTTGGCTCCAGCTCCACCTCCGGCATTACCG
GAGACAATACCACAACCTCCGTGTCCTGCCAAAGGGGATACAAAGGCGTCTGGAGAGGCGATGGCATTATGCATACCGATGCCATTGCGGAGCCGAA
ATCACAGGCCATGTGTTTCTGGTCGGCCAACTGTTTACCTTTAGCCCTAGGAGACACTGGACCACACAGGGATGCAATTGCTCCATCTATCCCGGACA
CATTTTCGTCGGCGCTGGCCTCGCCGGAGCCGCTATCGGAAGCGTCGGCCTCGGCAAAGTGCTCGTGGATATCCTCGCCGGATACGGAGCCGGAGACA
TTTGGGATTGGATTTGCGAAGTGCTCAGCGATTTCAAAACCTGGCTGAAAGCCAAACTGATGCCCCAACTGCCTGGCATTCCCTTTAACTCCAGCATT
GTGTATGAGGCTGCCGATGCCATTCTGCATACCCCTGGCTGTGTGCCTTGCGTCAGGGAAGGCAATGCCTCCAGGTGTAGCTCCGGCTGTCCCGAAAG
GCTCGCCTCCTGCAGAAGGCTCACCGATTTCGATCAGGGATGGGGACCCATTAGCTATGCCAATGGCTCCAGGACAGAGGAAGCCATTTACCAATGCT
GTGACCTCGACCCTCAGGCTAGGGTCGCCATTAAGTCCCTGACAGAGAGACTGTATGTGGGAGTGTCCAAGGGATGGAGACTGCTCGCCCCTATCACA
GCCTATGCCCAACAGACAAGGGGACTGCTCGGCTGTATCATTACCTCCCTGACATTCTTTAGCGTCCTGATTGCCAGAGACCAACTGGAACAGGCTCT
GGATTGCGAAATCTATGGCGCTTGCTATAGCATTGAGCCTCTGGATTGCCAAGTGCCTAGCCCTGAGTTTTTCACAGAGCTCGACGGAGTGAGACTGC
ATAGGTTTGCCCCTCCCTGTAAGCCTCTGCTCAGGGAAACCTGTTACATTAAGGCTAGGGCTGCCTGTAGGGCTGCCGGACTGCAAGACTGTACCATG
CTGGTCTGCGGAGACGATCTGGTCGTGATTATCGATCCCAATATCAGAACCGGAGTGGAGAACCATTACCACAGGCTCCCCCATTACCTATAGCACATA
CGGAAAGTTTCTGGCTGACGGATGCAATTGGACAAGGGGAGAGAGATGCGATCTGGAAGACAGAGACAGAAGCGAACTGTCCCCCCTCCTGCTCAGCA
CAACCCAATGGCAAACCGGACACAGAATGGCTTGGGATATGATGATGAATTGGTCCCCCACAGCCGCTCTGGTCATGGCTCAGCTCCTGAGAATCCCT
CAGGCTCCCGGAGCCCTCGTGGTCGGCGTCGTGTGTGCCGCTATCCTCAGGAGACACGTCGGCCCTGGCGAAGGCGCTGTGCAATGGATGAACAGACA
CGATAGCCCTGACGCTGAGCTCATCGAAGCCAATCTGCTCTGGAGACAGGAAATGGGAGGCAATATCACAAGGGTCGAGTCCGAGAATGAGGGAGTGT
TTACCGGACTGACACACATTGACGCTCACTTTCTGTCCCAGACAAAGCAAAGCGGAGAGAATTTCCCTTACCTCGTGGCTAGGGGAAGGAGACAGCCT
ATCCCTAAGGCTAGGAGACCCGAAGGCAGAACCTGGGCCCAACCCGGATACCCTTGGCCTCTGTATGGCAATCTGATTGTGTTTCCCGATCTGGGAGT
GAGAGTGTGTGAGAAAATGGCTCTGTATGACGTCGTGTCCAAGCTCCCCCTCGCCGTCATGGGATACGGCTACCGGAAACCTCCCCGGATGCTCCTTCT
CCATCTTTCTGCTCGCCCTCCTGTCCTGCCTCACCGTCCCCGCTAGCGCTTACCAACTGGGAAAGGTCCTGGTCGACATTCTGGCTGGCTATGCGCT
GGCGTCGCCGGAGCCCTCGTGGCTTTCAAAATCATGAGCGGAGAGGTCAGCTATAGCTCCATGCCTCCCCTCGAGGGAGAGCCTGGCGATCCCGATCT
GTCCGACGGAAGCTGGAGCACAGTGTCCAGCGAAGCCGGAAGGCGGAAGGTGGGCGGAAGCATTACCAGAGTGGAAAGCGAAAACAAAGTGGTCATCC
TCGACTCCTTCGATCCCCTCGGCTGAGGAAGTGGGATGGCCTGCCCCTCAGGGAAGCAGAAGCCTCACCCCTTGCACATGCGGAAGCTCCGACCTC
TACCTCGTGACAAGGCATGCCGATGGCTGTAGCGGAGGCGCTTACGATATCATTATCTGTGACGAATGCCATAGCACAGACGCTACCTCCATCCTCGG
CATTGGCACAGTGCTCACCTTTACCATTGAGACAACCACACTGCCTCAGGATGCCGTCAGCAGAACCCAAAGGAGAGGCAGAACCGGAAGGGGAAAGC
CTGGCATTGACTGTTTCAGAAAGCATCCCGAAGCCACATACTCCAGGTGTGGCTCCGGCCCTTGGATTACCCCTAGGTGTCTGGTCGACTATCCCTAT
CTGGCTGCCGGAGTGGGAATCTATCTGCTCCCCAATAGGGCTGCCGCCCTCGTGACACCCGTGCCGCTCGAGGAACAGAAACTGCCTATCAATGCCCT
CAGCAATAGCCTCCTGAGACACCATAACCTCGTGTATATCTCCAGCGAATGCACAACCCCTTGCTCCGGCTCCTGGCTCAGGGATATCTGGGACTGGA
TCTGTGAGGTCCTGTCCGACTTTAAGACATGGCTCAAGGCTAAGCTCATGCCTCAGCTCCCCGGAATCCCTTTCGTCAGCTGTCAGAGAGGCTATAAG
GGAGTGTGGAGGGGAGACGGAAGCGGACCCTGGATCACACCCAGATGCCTCGTGGATTACCCTTACAGACTGTGGCACTATCCCTGTACCATTAACTA
TACCATTTTCAAA
```

HepC Savine Cassette Sequences (A+B+C) with specific restriction sites removed which can be joined
to generate a single expressible open reading frame that encodes the hepc Savine protein above Cassette A

```
ggcggatccccaccATGGTGATTCCCGTCAGGAGAAGGGGAGACTCCAGGGGAAGCCTCCTGTCCCCCAGACCCATTAGC
TATCTGAAAGGCTCCAGCGGAGGCCCTGCCAGAAGGGGAAGGGAAATCCTCCTGGGACCCGCTGACGGAATGGTCAGCAA
AGGCTGGAGGCTCCTGGCTCCCATTACCGCTTACGCTAGGCTCCACAGATTCGCTCCCCCTTGCAAACCCCTCCTGAGAG
AGGAAGTGTCCTTCAGAGTGGGACTGCATGAGTATCCCGTCGGCTCCGTGGTCTTCCTGACAGATGGAGACAAAGCTCATC
ACATGGGGAGCCGATACCGCTGCCTGTGGCGATATCATTAACGGACTGCCTGTGTCCCTGCTCTGCCCTGCCGGACACGC
TGTCGGAATCTTTAGGGCTGCCGTCTGCACAAGGGGAGTGGCTAAGGCTGTGGATTTCATTCCCGTCTGCGTCGTGATTG
TGGGAAGGATTGTGCTCAGCGGAAAGCCTGCCATTATCCCTGACAGAGAGGTCCTGTATAGGGAgTTtGATGAGATGCCC
TGTACCCCTCTGCCTGCCCCTAACTATACCTTTGCCCTCTGGAGAGTGTCCGCCGAAGAGTATGTGGAAATCAGAAGGGT
CGGCGATGCCCTCTACGATGTGGTCAGCAAACTGCCTCTGGCTGTGATGGGCTCCAGCTATGGCTTTCAGTATAGCCCTG
GCCAAAGGGTCGAGTTTATCTCCTGGTGTCTGTGGTGGCTCCAGTATTTCCTCACCAGAGTGGAAGCCCAACTGCATGTG
TGGGTGCCTCCCCTCAACGTCAGGGGAGAGAATCTGGTCATCCTCAACGCTGCCTCCCTGGCTGGCACACGGACTGGT
CAGCTTTCTGGTCTTCTTTTGCTTTGCCTGGTACCTCTGCCTCCCATTATCCAAAGGCTCCACGGACTGTCCGCCCTTTA
GCCTCCACTCCTACTCCCCGGAGAGATTAACAGAGTGGCTGCCTGTAACCCTCCCCTCGTGGAAACCTGGAAGAAACCC
GATTACGAACCCCCTGTGGTCCACGGATGCCCTCTGCCTCCCCCTAGGTCCCCCCCTGGCGTCGGCTCCAGCATTGCCTC
```

Figure 26 (Cont)

```
CTGGGCTATCAAATGGGAATACGTCGTGCTCCTGTTTCTGCTCCTGGCTGACGCTAGGGTCTGCTCCCTGAATAACACAA
GGCCTCCCCTCGGCAATTGGTTTGGCTGTACCTGGATGAATAGCACAGGCTTTACCAAAGTGTGTGGCGCTCCCCCTTTC
ACAGAGGCTATGACAAGGTATAGCGCTCCCCCTGGCGATCCCCCTCAGCCTGAGTATGACCTCGAGCTCATCACAAGCTG
TAGCTCCTGGCCTCTGCTCCTGCTCCTGCTCGCCCTCCCCCAAAGGGCTTACGCTCTGGATACCGAAGTGGCTGCCTCCT
GCGGAGGCGTCGTGCTCCAGCAAACCAGAGGCCTCCTGGGATGCATTATCACAAGCCTCACCGGAAGGGATAAGAATCAG
GTCGAGGGAGAGGTCCAGATTGTGTCCAGCTCCCCCCCTGCCGTCCCCCAAAGCTTTCAGGTCGCCCATCTGCATGCCCC
TACCGGAAGCGGAAAGTCCACCAAAGTGCCTGCCGCTAACACACCGGACTGCCTGTGTGTCAGGATCACCTCGAGTTTT
GGGAAGGCGTCTTCACAGGCCTCACCCATATCGATGCCCATTTCCTCGTGCTCCTGCTCTTCGCTGGCGTgGAtGCTGAG
ACACACGTCACCGGAGGCAATGCCGGAAGGACAACCTCCGGCCTCGTGTCCCTGCTCGAGGTCACCCTCACCCATCCCGT
CACCAAATACATTATGACATGCATGAGCGCTGACCTCGAGGTCGTGACAAGCACATGGGTCCTGGTCGTGGGACTGATGG
CCCTCACCCTCAGCCCTTACTATAAGAGATACATTAGCTGGTGCCTCTGGTGGCTGCAATACTTTCTGACAAGGGTCGCC
ATTTGCGGAAAGTATCTGTTTAACTGGGCCGTCAGGACAAAGCTCAAGCTCACCCCTATCGCTGCCGCTGGCAGACTGGA
TCTGTCCATCGCTTACTTTAGCATGGTGGGAAACTGGGCCAAAGTGCTCGTGGTCCTGCTCCTGTTTGCCGGAGTGGATG
CCGAAACCCATGTGACAAGGCTCGCCAGAGGCTCCCCCCCTAGCATGGCCTCCAGCTCCGCCTCCCAGCTCAGCGCTCCC
TCCCTGAAAGCCACATGCACAGCCAATGGCCTCGTGTCCTTCCTCGTGTTTTTCTGTTTCGCTTGGTATCTGAAAGGCAG
ATGGGTCCCCGGAGCCGTCTACGCTCTGTATGGCATGCAGCTCCCCTGTGAGCCTGACGTCGCCGTCCTGACAA
GCATGCTGACAGACCCTAGCCATATCACAGCCGAAGCCGTCTGGCAGAGACTCCGTGACACCCATTGACACAACCATTATG
GCTAAGAATGAGGTCTTCTGTGTGCAACCCGAAAAGGGAGGCAGAAAGCCTGCCAGATACGCTGCCCAAGGCTATAAGGT
CCTGGTCCTGAATCCCTCCGTGGCTGCCACACTGGGATTCGGAGCCTATATGTCCAAGGCTCACGGAGTGAGAAACTCCA
CCGGACTGTATCACGTCACCAATGACTGTCCCAATAGCTCCATCGTCTACGAAGCCGCTGACGCTATCCTCCACACAAGC
TCCTACGGATTCCAATACTCCCCCGGACAGAGAGTGGAgTTtCTCGTGCAAGCCTGGAAGTCCAAGAAAACCCCTATGGG
ATTCTCCGACACAGCCGCTTGCGGAGACATTATCAATGGCCTCCCCGTCAGCGCTAGGAGAGGCAGAGAGATTCTGCTCG
GCCCTGCCGATGGCATGAGCCAACTGTCCGCCCCTAGCCTCAAGGCTACCTGTACCGCTAACCATGACTCCCCCGATGCC
GAACTGATTGAGGCTAACCTCCTGTGGAACCCTGCCATTGCCTCCTGATGGCCTTTACCGCTGCCGTCACCTCCCCCCT
CACCACAAGCCAAACCCTCCTGTTTAACATTCTGGGACTGGTCCAGGCTTGGAAAAGCAAAAAGACACCCATGGGCTTTA
GCTATGACACAAGGTGTTTCGATAGCACAGTGACAGAGTCCGACATTGACGAAAGGGAAATCTCCGTGCCTGCCGAAATC
CTCAGGAAAAGCAGAAGGTTTGCCCAAGCCCTCCCCGTCTGGGCTAGGCCTGACTATATGTTTTGCCCTACCCTCTGGGC
TAGGATGATCCTCATGACACACTTTTTCTCCGTGCTCATCGCTAGGGATCAGCTCGAGCAAGCCCTCAGCGTCATCCCTA
CCTCCGGCGATGTGGTCGTGGTCGCCACAGACGCTCTGATGACCGGATACACAGGCGATTTCGATAGCGTCATCGATTGC
CATAGCAAAAGAAATGCGATGAGCTCGCCGCTAAGCTCGTGGCTCTGGGAATCAATGCCGTCGCCTATTACAGAGGCCT
CGACGTCGTGCTCCCCTGTAGCTTTACCACACTGCCTGCCCTCAGCACAGGCCTCATCCATCTGCATCAGAATATCGTgG
AtGTCCAGTATCTGTATAAGGGAAGGTGGGTGCCTGGCGCTGTGTATGCCCTCTACGGAATGTGGCCCCTCCTGCTCCTG
CTCCTGGCTCTGCCTCAGAGAGCCTATAGCCCTATCACATACTCCACCTATGGCAAATTCCTCGCCGATGGCGGATGCTC
CGGCGGAGCCTATGACATTATCATTTGCGATGAGTGTGCCAGAAGCGTCAGGGCTAGGCTCCTGGCTAGGGGAGGCAGAG
CCGCTATCTGTGGCAAATACCTCTTCAATTGGGCTGTGAGAACCAAAAAGGCTGTGGCTCACATTAACTCCGTGTGGAAG
GATCTGCTCGAGGATAGCGTCACCCCTATCGATACCACAATCATGGCCAAAAACGAgTTtACACCCTCCCCCGTCGTGGT
CGGCACAACCGATAGGTCCGGCGCTCCCACATACTCCTGGGGAGCCAATGACACAGACGTCTTCGTCCCCGGATGCGTCC
CCTGTGTGAGAGAGGGAAACGCTAGCAGATGCTGGCTGCACACCCACAGTGGGTCGCTACCAGAGACGGAAAGCTCCAG
GATTGCACAATGCTCGTGTGTGGCGATGACCTCGTGGTCATCTGTGAGTCCGCCGGAGTGCAAGAGGATGCCGCTAGCCT
CAGGGCTGTGGCTGGCGCTCTGGTCGCCTTTAAGATTATGTCCGGCGAAGTGCCTAGCACAGAGGATCTGGTCAACCTCC
TGCCTGCCATTCTGTCCTACGATACCAGATGCTTTGACTCCACCGTCACCGAAAGCGATATCGAACCGAAGAGGCTATC
TATCAGTGTTGCGATCTcGAcCCCCAAGAGCTCACCCCTGCCGAAACCACAGTGAGACTGAGAGCCTATATGAATACCCC
TGGCCTCCCCGTCTGCCAAGACCATCTGGAgTTtTGGCCCCAACCCGAATACGATCTGGAACTGATTACCTCCTGCTCCA
GCAATGTGTCCGTGGCTCACGATGGCGCTGGCAAAAGGGCTCTACTATCTGGGAAAGGTCATCGATACCCTCACCTGTGGC
TTTGCCGATCTGATGGGCTATATCCCTCTGGTCGGCGCTCCCCTCGGCGGAGCCGCTGCCATTCCCCTCGAGGTCATCAA
AGGCGGAAGGCATCTGATTTTCTGTCACTCCAAGAAAAAGTGTGACGAACTGGCTGCCAAACTGGTCGGCGGAGTGCTCG
CCGCTCTGGCTGCCTATTGCCTCAGCACAGGCTGTGTGGTCATCGTCGGCAGAATCGTCCTGTCCGGCAAACCCGCTTGC
GAAAGCGCTGGCGTCCAGGAAGACGCTGCCTCCCTGAGAGCCTTTACCGAAGCCATGACCAGATACTCCGCCCCTCCCGG
AGACCCTGGCTGGTTCACAGCCGGATACTCCGGCGGAGACATTTACCATAGCGTCAGCCATGCCAGACCCAGATGGTTTT
GGTTTTGCCTCCTGCTCAGCTCCAGCACAAGCGGAATCACAGGCGATAACACAACCACAAGCTCCGAGCCTGCCCCTAGC
GGATGCCCTCCCGATAGCGATGCCGAAGGACACAGAGAAGGGGAAGGACAGGCAGAGGCAAACCCGGAATCTATAGGTT
TGTGGCTCCCGGAGAGAGACCCTCCGGCATGTTCGATGTGAGAATGTATGTGGGAGGCGTCGAGCATAGGCTCGAGGCTG
CCTGTAACTGGACCAGAGGCGAAAGGTGTGACCTCGAGGATAGGGATGAGGCTCAGCTCCACGTCTGGGTCCCCCCTCTG
AATGTGAGAGGCGGAAGGGATGCCGTCATCCTCCTGATGTGCGTCGTGCATCCCACACTGGGAGTGAGAGCCACAAGGAA
AACCTCCGAGAGAAGCCAACCCAGAGGCAGAAGGCAACCCATTCCCAAAGCCAGAAGGCCTGAGGGAAACGTCAGCGTCG
CCCATGACGGAGCCGGAAAGAGAGTGTATTACCTCACCGAGACCCTACCACACCCCTCGCCAGAGCCGCTTGGGAAAGC
GAACCCGCTCCCTCCGGCTGTCCCCCTGACTCCGACGCTGAGTCCTACTCCAGCATGCCCCCTCTGGAAGGCGAACCCGG
AGACCCTATCGGAGGCCATTACGTCCAGATGGCCATTATCAAACTGGGAGCCCTCACCGGAACCTATGTGTATAACCATC
TGACACCCTCAGaGAcCCCTCCACCGAAGACCTCGTGAATCTGCTCGTCGCTATCCTCAGCCCTGGCGCTCTGGTCGTG
GGAGTGGTCTGCGCTGCCATTCTGAGAATCCTCGACATGATCGCTGGCGCTCACTGGGGCGTCCTGGCTGGCATTGCCTA
TTTCTCCATGGTCGGCAATTGGGCTAAGGTCCTGGTCGAGGGGATGCGGATGGGCTGGCTGGCTGCTCAGCCCTAGGGGAA
GCAGACCCTCCTGGGGACCCACAGACCCTAGGAGAAGGTCCAGGAATgtcgactgagaattcgcc
```

Cassette B

```
ggcggatccaccatgctcgagTGGACAACCCAAGGCTGTAACTGTAGCATTTACCCTGGCCATATCACAGGCCATAGGAT
GGCCTGGGACATGATGATGAACTGGAGCCCTTGGGTCGCCATGACCCCTACCGTCGCCACAAGGGATGGCAAACTGCCTG
CCACACAGCTCAGGAGACACATTGACCTCCTGGTCGGCTCCAGCCTGTCCAGCATTCTGCAATCAATTACACAATC
TTTAAGGTCAGGATGTACGTCGGCGGAGTGGAACACAGACTGGAAGCCGCTGTGTTTTGCGTCCAGCCTGAGAAAGGCGG
AAGGAAACCCGCTAGGCTCATCGTCTTCCCTGACCTCGGCGTCAGGGTCTGCGAAAAGATGATGGGATACATTCCCCTCG
TGGGAGCCCCTCTGGGAGGCGCTGCCAGAGCCCTCGCCCATGGCGTCAGGGTCCTGGAAGACGGAGTGAATGGCGGAAAC
```

Figure 26 (Cont)

```
GCTGGCAGAACCACAAGCGGACTGGTCAGCCTCCTGACACCCGGAGCCAAACAGAATATCCAACTGATTAACACAAACGG
ACTGGCTCTGCTCAGCTGTCTGACAGTGCCTGCCTCCGCCTATCAGGTCAGGAATAGCACAGGCCTCTACCATGTGACAA
ACGATTGCCCTGGCAGAGACAAAAACCAAGTGGAAGGCGAAGTGCAAATCGTCAGCACAGCCGCTCAGACATTCCTCGCC
ACATGCATTAACGGAGTGTGTCCCGCTACCCAACTGAGAAGGCATATCGATCTGCTCGTGGGAAGCGCTACCCTCTGCTC
CGCCCTCTACGTCGGCGATCTGTGTGGCTCCCACGCTCCCACAGGCTCCGGCAAAAGCACAAAGGTCCCCGCTGCCTATG
CCGCTCAGGGATACAAAGTGCTCGTGCTCAACCCTAGCGTCAGGACATGGGCTCAGCCTGGCTATCCCTGGCCCCTCTAC
GGAAACGAAGGCTGTGGCTGGGCCGGATGGCTCCTGTCCCCCAGAGGCTCCACCGAAGACGTCGTGTGTTGCTCCATGTC
CTACTCCTGGACAGGCGCTCTGGTCACCCCTTGCGCTGCCGAAGAGCAAAAGCTCCCCATTGCCCTCGACACAGAGGTCG
CCGCTAGCTGTGGCGAGTGGTCCTGGTCGGCCTCATGGCTCTGACACTGTCCCCTATTACAAAAGGTATTGGATGAAC
TCCACCGGATTCACAAAGGTCTGCGGAGCCCCTCCCTGTGTGATTGGCGGAGCCGGAAACAATACCCTCCACTGTCCCAC
AAGCGTCGAGGAAGCCTGTAGCCTCACCCCTCCCCATAGCGCTAAGTCCAAGTTTGGCTATGGCGCTAAGGATGTGAGAT
GCCATGCCAGAATCTCCGGCATTCAGTATCTGGCTGGCCTCAGCACACTGCCTGGCAATCCCGCTATCGCTAGCCTCATG
GCTTTCACAGCCGCTGTGACACAGATTGTGGGAGGCGTCTACCTCCTGCCTAGGAGAGGCCCTAGGCTCGGCGTCAGGGC
TACCAGAAAGACAAGCGAAAGGTCCCAGCCTCTGCATAGCTATAGCCCTGGCGAAATCAATAGGGTCGCCGCTTGCCTCA
GGAAACTGGGAGTGCCTCCCCTCAGGGCTTGGAGACACAGAACCGCTAGGCATACCCCTGTGAATAGCTGGCTGGGAAAC
ATTATCATGTTCGCTCCCACACTGTGGGCCAGAATGATTCTGATGACCCATGAGAATCTGGAAACCACAATGAGAAGCCC
TGTGTTTACCGATAACTCCAGCCCTCCCGCTGTGCCTCAGTCCTTCCAAGTGGCTCACCTCGCCACACCCCTGGCTCCG
TGACAGTGCCTCACCCTAACATTGAGGAAGTGGCTCTGTCCACCACAGGCGAAATCCCTTTCTATGGCAAACTGGTCTTC
GATATCACAAAGCTCCTGCTCGCCGTCTTCGGACCCCTCTGGATTCTGCAAGCCTCCCTGCTCAAGGTCCCCTATTTCGT
CACCGCTGCCCTCGTGATGGCCCAACTGCTCAGGATTCCCCAAGCCATTCTGGATATGATTGCCGGAGCCCATTGGGGAG
TGCTCGCCGGATGCAATACCTGTGTGACACAGACAGTGGATTTCTCCCTcGAcCCCACATTCACAATCGAAACCACAACC
CTCCCCCAAGACGCTGTGTCCCACGGACCCACACCCCTCCTGTATAGGCTCGGCGCTGTGCAAAACGAAGTGACACTGAC
ACACCCTGTGACAAAGTATATCATGACCTGTGCCAGAGTGGCTATCAAAAGCCTCACCGAAAGGCTCTACGTCGGCGGAC
CCCTCACCAATACAGAGGCGAAAACTGTGGCTATAGGAGATGCGTCATCGGAGGCGCTGGCAATAACACACTGCATTGC
CCTACCGATTGCTTTAGGAAACACCCTGAGGCTACCTATAGCAGATGCGGAACCTGTGGCTCCAGCGATCTGTATCTGGT
CACCAGACACGCTGACGTCATCCCTGTGAGAAGGAGAGGCGATAGCAGAGGCTCCCTGCTCAACATGTGGTCCGGCACAT
TCCCTATCAATGCCTATACCACAGGCCCTTGCACACCCCTCCCCGCTCCCAATTACACATTCGCTCTGTGGCACTCCACC
GATGCCACAAGCATTCTGGGAATCGGAACCGTCCTGGATCAGGCTGAGACAGCCGGAGCCAGACTGGTCGTGCTCGCCAC
ATACGTCCCCGAAAGCGATGCCGCTGCCAGAGTGACAGCCATTCTGTCCAGCCTCACCGTCACCCAACTGCTCAGGAGAC
TGCATCAGTGGAGGCCTAGCTGGGGCCCTACCGATCCCAGAAGGAGAACCAGACAGAAGCTCGGCAAAGTGATTGACACACTG
ACATGCGGATTCGCTGACCTCGGCCCTGACAAAAGGCCTTACTGTTGGCATTACCCTCCCAAACCCTGTGGCATTGTGCC
TGCCAAAAGCGTCTGCGGACCCGTCTACTGTGAGGAATGCTCCCAGCATCTGCCTTACATTGAGCAAGGCATGATGCTCG
CCGAACAGTTTAAGCAAAAGGCTCTGGGACTGCTCCAGACATACCAAGCCACAGTGTGTGCCAGAGCCCAAGCCCCTCCC
CCTAGCTGGGACCAAATGTGGAAGTGTCTGATTAGGCTCAAGCCTACCCTCTGCGGAATCGTCCCCGCTAAGTCCGTGTG
TGGCCCTGTGTATTGCTTTACCCCTAGCCCTGTGGTCGTGGGAACCACAGACAGAGGCGAAGCTCCCTGACAGTGACAC
AGCTCCTGAGAAGGCTCCACCAATGGATTAGCTCCGAGTGTACCACACCCTGTAGCGGAAGCTGGCTGAGAGACCTCAGC
GATGGCTCCTGGTCCACCGTCAGCTCCGAGGCTGGCACAGAGGATGTGGTCTGCTGTAGCATGAGCTATAGCTGGACCGG
ATGGGATCAGATGTGGAAATGCCTCATCAGACTGAAACCCACACTGCATGGCCCTACCCCTCTGCTCTACAGACTGGGAG
CCGTCCAGAATCTGGCTGAGCAATTCAAACAGAAAGCCCTCGGCCTCCTGCAAACCGCTAGCAGACAGGCTGAGGTCATC
GCTCCCGCTGTGCAAACCAATTGGCAAAAGCTCGAGGTCTTCTGGGCAAACACATGTGGAATTTCATTAGCGGAATCCA
ATACCTCGCCGGACTGTCCACCCTCCCCGGACTGATTGCCTTTGCCTCCAGGGGAAACCATGTGTCCCCCACACACTATG
TGCCTGAGTCCGACGCTGCCGCTAGGGTCACCGCTATCCTCGCCACACTGTGTAGCGCTCTGTATGTGGGAGACCTCTGC
GGAAGCGTCTTCCTCGTGGGACAGCTCTTCACATTCTCCCCAGAAGGCATAGCTCCGTGCTCTGCGAATGCTATGACGC
TGGCTGTGCCTGGTACGAACTGACACCCGCTGAGACAACCGTCAGGCTCAGGGCTTACATGGGCTGGGTGGCTGCCCAAC
TGGCTGCCCCTGGCGCTGCCACAGCCTTTGTGGGAGCCGGACTGGCTGGCGCTGCCATTGGCTCCGTGGGAAGCTGGCAC
ATTAACTCCACCGCTCTGAATTGCAATGAGTCCCTGAATACCGGATGCTCGCCGGACTGTTTTTACCAACACAAATTCAA
TAACGCTCTGTCCAACTCCCTGCTCAGGCATCACAATCTGGCTACTCCACCACAAGCAGAAGCGCTTGCCAAAGGCAAA
AGAAAGTGACAGCCGCTATGTCCACCAATCCCAAACCCCAAAGGAAAACCAAAAGGAATACCAATAGGAGACCCCAAGAC
GTCAAGTTTCCCGGAGGCGGAAGCCAAACCAAACAGTCCGGCGAAAACTTTCCCTATCTGGTCGCCTATCAGGCTACCGT
CTGCGCTAGGGCTCAGGCTCCCCCTCCCTCCGCCCCTACCTATAGCTGGGGCGCTAACGATACCGATGTGTTTGTGCTCA
ACAATACCAGACCCCCTCTGGGAAACTGGTTCGGATGCACAGTGCCTCCCCCTAGGAAAAAAGAACCGTCGTGCTCACC
GAAAGCACACTGTCCACCGCTCTGGCTCGAGCTCGCCACAAAGTCCTTCGGAAGCACAACCTCCAGGTCCGCCTGTCAGAG
ACAGAAAAAGGTCACCTTTGACAGACTGCAAGTGCTCGACTCCCACTATCAGGATGTGCTCGACCAAGCCGAAACCGCTG
GCGCTAGGCTCGTGGTCCTGGCTACCGCTACCCCTCCCGGAAGCGTCACCGTCCCCCATCCCAATATCGAgTTtCATTAC
GTCACCGGAATGACAACCGATAACCTCAAGTGTCCCTGTCAGGTCCCCTCCCCCGAgTTtTTTACCGAACTGGATGGCGT
CCTGAAACTGACACCCATTGCCGCTGCCGGAAGGCTCGACCTCAGCGGATGGTTTACCGCTGGCTATAGCGGAGGCGATA
TCTATCACTCCGCCTCCAGGCAAGCCGAAGTGATTGCCCCTGCCCTCCAGACAACCTGGCAGAAACTGGAAGTGTTTTGG
GCTAAGCATATGTGGAACTTTTGCAGAGCCTCCGGCGTCCTGACAACCTCCTGCGGAAACACACTGACATGCTATATCAA
AGCCAGAGCCGCTTGCAGAGCCGCTGGCCTCTTCGATAGGCTCCAGGTCCTGGATAGCCATTACCAAGACGTCCTGAAAG
AGGTCAAGGCTGCCGCTAGCAAAGTGAAAGCCAATCTGCTCGGCCCTCTGACAAAACTCCAGGGGAGAGAATTGCGGATAC
AGAAGGTGTAGGGCTAGCGAGTGCTCACCACAAGCTGTGGCAATACCCTCATCATGCACACAAGGTGTCACTGTGGCGC
TGAGATTACCGGACACGTCAAGAATGGCACAATGAGAATCGTCGGCCCTAGGACATGCAGAGAGGTCAGCTTTAGGGTCG
GCCCTCCACGAATACCCCTGTGGGAAGCCAACTGCCTTGCGAACCCGAACCCGATGTGGCTGTGCTCACCTCCAAGGAAGTG
AAAGCCGCTGCCTCCAAGGTCAAGGCTAACCTCCTGTCCGTGGAAGAGGCTTGCTCCCTGACACCCCCTCACTCCGCCAA
AGGCAGAGACGCTGTGATTCTGCTCATGTGTGTGGTCCACCCTACCCTCGTGTTTGACATTACCAAACTGCTCCTGGCTG
TGTTTGGCCCTATGCTCACCGATCCCTCCCACATTACCGCTGAGGCTGCCGGAAGGAGACTGGCTAGGGGAAGCCCTCCC
TCCATGGCTAGCTCCAGCGCTAGCCCTAGGCCTATCTCCTACCTCAAGGGAAGCTCCGGCGGACCCCTCCTGTGTCCCGC
TGGCCATGCCGTCGGCATTTTCAGAGCCGCTGACTTTGACCAAGGCTGGGCCCTATCTCCTACGCTAACGGAAGCGGAC
CCGATCAGAGACCCTATTCCTGGCACTATCCCCCTAAGCCTAGGCATGTGGGACCCGGAGAGGGAGCCGTCCAGTGGATG
AATAGGCTCATCGCTTTCGCTAGCAGAGGCAATCACGTCAGCCCTACCCATCtcgagtgagaattcgcc
```

Figure 26 (Cont)

Cassette C

```
ggcggatccaccatgctcgagTGCCTCTGGATGATGCTCCTGATTAGCCAAGCCGAAGCCGCTCTGGAAAACCTCGTGAT
TCTGAATGCCGCTAGCCTCGCCGGAACCCATATCATTCCCGATAGGGAAGTGCTCTACAGAGAGTTTGACGAAATGGAAG
AGTGTAGCCAACACCTCCCCTATATCGAACAGGGAATGATGCTGATTCACCTCCACCAAAACATTGTGGATGTGCAATAC
CTCTACGGAGTGGGAAGCTCCATCGCTAGCTGGGCCATTAAGTGGGAGTATGTGTCCCACGCTAGGCCTAGGTGGTTCTG
GTTCTGTCTGCTCCTGCTCGCCGCTGGCGTCGGCATTTACCTCCGCTGCCTAACAGAGCCGCTGCCGCTACCCTCGGCTTTG
GCGCTTACATGAGCAAAGCCCATGGCATTGACCCTAACATTAGGACAGGCGTCAGGACAATCACAACCGGAAGGGTCCAG
GGACTGCTCAGGATTTGCGCTCTGGCTAGGAAAATGATTGGCGGACACTATGTGCAAATGGCTATCATTAAGCTCGGCGC
TAGGAGATTCGCTCAGGCTCTGCCTGTGTGGGCCAGACCCGATTACAATCCCCCTCTGGTCGAGACATGGAAAAGCCTG
ACTATGAGCCTACCGCTGCCCAAACCTTTCTGGCTACCTGTATCAATGGCGTCTGCTGGACCGTCTACCATGGCGCTGGC
ACAAGGACAATCGCTAGCCCTTGGGCTCACAATGGCCTCAGGGATCTGGCTGTGGCTGTGGAACCCGTCGTGTTTAGCCA
AATGGAAACCAAACTGATTACCTGGGGCGCTAAGGGACCCGTCATCCAAATGTATACCAATGTGGATCAGGATCTGGTCG
GCTGGCCCGCTCCCCAAGGCTCCAGGTCCCTGACACCCTGTAAGGTCGTGATTCTGGATAGCTTTGACCCTCTGGTCGCC
GAAGAGGATGAGAGAGAGATTAGCGTCCCCGCTGAGATTCTGAGAAAGTCCCTGACAGGCACATACGTCTACAATCACCT
CACCCCTCTGAGAGACTGGGCCCATAACGGACTGAGAGACCTCGCCGTCGCCGTCGAGCCTGTGTGTACCAGAGGCGTCG
CCAAAGCCGTgGAtTTTATCCCTGTGGAAAACCTCGAGACAACCATGAGGTCCCCCGTCTTCACAGACAATGCCCTCGGC
ATTAACGCTGTGGCTTACTATAGGGGACTGGATGTGTCCGTGATTCCCACAAGCGGAGACGTCGTGGTCGTGGCTACCGA
TATGTCCGCCGATCTGGAAGTGGTCACCTCCACCTGGGTGCTCGTGGGAGGCGTCCTGGCTGCCCTCGCCGCTTACTGTC
TGTCCACCGGAGCCCTCATGACAGGCTATACCGGAGACTTTGACTCCGTGATTGACTGTAACACATGCGTCACCCAAACC
GTgGAtTTTAGCCTCGACCCTAACACAAACAGAAGGCCTCAGGATGTGAAATTCCCTGGCGGAGGCCAAATCGTCGGCGG
AGTGTATCTGCTCCCCAGAAGGGGACCCAGAAGGGCTCTGGCTCACGGAGTGAGAGTGCTCGAGGATGGCGTCAACTATG
CCACAGGCAATCTGCCTGGCTGTAGCTTTAGCATTTTCCTCAGCAAATTCGGATACGGAGCCAAAGACGTCAGGTGTCAC
GCTAGGAAAGCCGTCGCCCATATCAATAGCGTCTGGAAAGACCTCCTGGAAAACCCTGGCGCTAAGCAAAACATTCAGCT
CATCAATACCAATGGCTCCTGGCATATCAATAGCACAGCCCTCAACTGTAACGAAAGCCTCAACACAGGCTGGCTGGCTG
GCCTCTTCTATCAGCATAAGTTTAACTCCAGCGGATGCCCTGAGAGACTGGCTAGCTGTAGGAGACTGACAGTGGTCCTG
CTCTTCCTCCTGCTCGCCGATGCCAGAGTGTGTAGCTGTCTGTGGATGATGCTGCTCATCTCCCAGGCTGAGGCTGCCCT
CGACTGTGAGATTTACGGAGCCTGTTACTCCATCGAACCCCTCGACCTCCCCCCTATCATTCAGAGACTGCATGGCCTCA
GCGCTTTCTCCTGGACAGTGTATCACGGAGCCGGAACCAGAACCATTGCCTCCCCCAAAGGCCCTGTGATTCAGATGTAC
ACAAACGTgGAtCAAGACCTCTACAGATTCGTCGCCCCTGGCGAAAGGCCTAGCGGAATGTTTGACTCCAGCGTCCTGTG
TGAGTGTTACGATGCCGGATGCGCTTGGTATAGGTCCGAGCTCAGCCCTCTGCTCCTGTCCACCACACAGTGGCAGGTCC
TGCCTTGCTCCTTCACAACCCTCCCCGCTCTGTCCACCGGACTGAGAAAGCTCGGCGTCCCCCCTCTGAGAGCCTGGAGG
CATAGGGCTAGGTCCGTGAGAGCCAGACTGCTCGCCAGAGGCGGAAGGGCTAGCCCTCTGACAACCTCCCAGACACTGCT
CTTCAATATCCTGGCGGCTGGTCGCCGCTCAGCTCGCCGCTCCCGGAGCCGCTACCGCTCTGTGGATtCTCCAGGCTA
GCCTCCTGAAAGTGCCTTACTTTGTGAGAGTGCAAGGCCTCCTGAGAATCTGTGCCCTCGCCAGAAAGATGGTGAAAAAC
GGAACCATGAGGATTGTGGGACCCAGAACCTGTAGGAATATGTGGAGCGGAACCTTTCCCATTAACGCTTACACAACCGG
AGAGGTCGCCCTCAGCACAACCGGAGAGATTCCCTTTTACGGAAAGGCTATCCCTCTGGAAGTGATTAAGGGAGGCAGAC
ACCTCATCTTTCTGACAAGAGACCCCACAACCCCTCTGGCTAGGGCTGCCTGGGAGACAGCCAGACACACACCCGTCAAC
TCCTGGCTCGGCAATATCATTAGGGTCAGCGCTGAGGAATACGTCGAGATTAGGAGAGTGGGAGACTTTCACTATGTGAC
AGGCATGACCACAGACAATCTGAAATGCCCTCCCGTCGTGCATGGCTGTCCCCTCCCCCTCCCAGAAGCCCTCCCGTCC
CCCCTCCCAGAAAGAAAAGGACAGTGGTCCTGACAGAGTCCACCCTCAGCACAGCCCTCGCCGAACTGGCTACCAAAAGC
TTTGGCTCCAGCTCCACCTCCGGCATTACCGGAGACAATACCACAACCTCCGTGTCCTGCCAAAGGGGATACAAAGGCGT
CTGGAGAGGCGATGGCATTATGCATACCAGATGCCATTGCGGAGCCGAAATCACAGGCCATGTGTTTCTGGTCGGCCAAC
TGTTTACCTTTAGCCCTAGGAGACACTGGACCACACAGGGATGCAATTGCTCCATCTATCCCGGACACATTTTCGTCGGC
GCTGGCCTCGCCGGAGCCGCTATCGGAAGCGTCGGCCTCGGCAAAGTGCTCGTGGATATCCTCGCCGGATACGGAGCCGG
AGACATTTGGGATTGGATTTGCGAAGTGCTCAGCGATTTCAAAACCTGGCTGAAAGCCAAACTGATGCCCCAACTGCCTG
GCATTCCCTTTAACTCCAGCATTGTGTATGAGGCTGCCGATGCCATTCTGCATACCCCTGGCTGTGTGCCCTTGCGTCAGG
GAAGGCAATGCCTCCAGGTGTAGCTCCGGCTGTCCCGAAAGGCTCGCCTCCTGCAGAAGGCTCACCGATTTCGATCAGGG
ATGGGGACCCATTAGCTATGCCAATGGCTCCAGGACAGAGGAAGCCATTTACCAATGCTGTGACCTCGACCCTCAGGCTA
GGGTCGCCATTAAGTCCCTGACAGAGAGACTGTATGTGGGAGTGTCCAAGGGATGGAGACTGCTCGCCCCCTATCACAGCC
TATGCCCAACAGACAAGGGGACTGCTCGGCTGTATCATTACCTCCCTGACATTCTTTAGCGTCCTGATTGCCAGAGACCA
ACTGGAACAGGCTCTGGATTGCGAAATCTATGGCGCTTGCTATAGCATTGAGCCTCTGGATTGCAAGTGCCTAGCCCTG
AGTTTTTCACAGAGCTCGACGGAGTGAGACTGCATAGGTTTGCCCCTCCCTGTAAGCCTCTGCTCAGGGAAACCTGTTAC
ATTAAGGCTAGGGCTGCCTGTAGGGCTGCCGGACTGCAAGACTGTACCATGCTGGTCTGCGGAGACGATCTGGTCGTGAT
TATCGATCCCAATATCAGAACCGGAGTGAGAACCATTACCACAGGCTCCCCCATTACCTATAGCACATACGGAAAGTTTC
TGGCTGACGGATGCAATTGGACAAGGGGAGAGAGATGCCGATCTGGAAGACAGAGACAGAAGCGAACTGTCCCCCCTCCTG
CTCAGCACAACCCAATGGCAAACCGGACACAGAATGGCTTGGGATATGATGATGAATTGGTCCCCCACAGCCGCTCTGGT
CATGGCTCAGCTCCTGAGAATCCCTCAGGCTCCCGGAGCCCTCGTGGTCGGCGTCGTGTGTGCCGCTATCCTCAGGAGAC
ACGTCGGCCCTGGCGAAGGCGCTGTGCAATGGATGAACAGACACGATAGCCCTGACGCTGAGCTCATCGAAGCCAATCTG
CTCTGGAGACAGGAAATGGGAGGCAATATCACAAGGGTGCGAGTCCCGAACAGAGCCTGGCAGATCACATACACACAT
TGACGCTCACTTTCTGTCCCAGACAAAGCAAAGCGGAGAGAATTTCCCTTACCTCGTGGCTAGGGGAAGGAGACAGCCTA
TCCCTAAGGCTAGGAGACCCGAAGGCAGAACCTGGGCCCAACCCGGATACCCTTGGCCTCTGTATGGCAATCTGATTGTG
TTTCCCGATCTGGGAGTGAGAGTGTGTGAGAAAATGGCTCTGTATGACGTCGTGTCCAAGCTCCCCCTCGCCGTCATGGG
ATACGCTACCGGAAACCTCCCCGGATGCTCCTTCTCCATCTTTCTGCTCGCCCTCCTGTCCTGCCTCACCGTCCCCGCTA
GCGCTTACCAACTGGGAAAGGTCCTGGTgGAtATTCTGGCTGGCTATGGCGCTGGCGTCGCCGGAGCCCTCGTGGCTTTC
AAAATCATGAGCGGAGAGGTCAGCTATAGCTCCATGCCTCCCCTCGAGGGAGAGCCTGGCGATCCCGATCTGTCCGACGG
AAGCTGGAGCACAGTGTCCAGCGAAGCCGGAAGGCAAGAGATGGGCGGAAACATTACCAGAGTCGGAAAGCGAAAACAAAG
TGGTCATCCTCGACTCCTTCGATCCCCTCGTGGCTGAGGAAGTGGGATGGCCTGCCCCTCAGGGAAGCAGAAGCCTCACC
CCTTGCACATGCGGAAGCTCCGACCTCTACCTCGTGACAAGGCATGCCGATGGCTGTAGCGGAGGCGCTTACGATATCAT
TATCTGTGACGAATGCCATAGCACAGACGCTACCTCCATCCTCGGCATTGGCACAGTGCTCACCTTTACCATTGAGACAA
CCACACTGCCTCAGGATGCCGTCAGCAGACCCAAAGGAGGAGGCAGAACCGGAAGGGGAAAGCCTGGCATTGACTGTTTC
AGAAAGCATCCCGAAGCCACATACTCCAGGTGTGGCTCCGGCCCTTGGATTACCCCTAGGTGTCTGGTgGAtTATCCCTA
TCTGGCTGCCGGAGTGGGAATCTATCTGCTCCCCAATAGGGCTGCCGCCCTCGTGACACCCTGTGCCGCTGAGGAACAGA
```

Figure 26 (Cont)

```
AACTGCCTATCAATGCCCTCAGCAATAGCCTCCTGAGACACCATAACCTCGTGTATATCTCCAGCGAATGCACAACCCCT
TGCTCCGGCTCCTGGCTCAGGGATATCTGGGACTGGATCTGTGAGGTCCTGTCCGACTTTAAGACATGGCTCAAGGCTAA
GCTCATGCCTCAGCTCCCCGGAATCCCTTTCGTCAGCTGTCAGAGAGGCTATAAGGGAGTGTGGAGGGGAGACGGAAGCG
GACCCTGGATCACACCCAGATGCCTCGTGGATTACCCTTACAGACTGTGGCACTATCCCTGTACCATTAACTATACCATT
TTCAAAagatctTGAgtcgacgaattcgcc
```

Figure 26 (Cont)

Melanoma Savine design

Two savines — one containing scrambled melanocyte differentiation Ags
— one containing scrambled melanoma cancer specific Ags Genes in melanocyte differentiation Savine gp100
MDLVLKRCLLHLAVIGALLAVGATKVPRNQDWLGVSRQLRTKAWNRQLYPEWTEAQRLDCWRGGQVSLKVSNDGPTLI
GANASFSIALNFPGSQKVLPDGQVIWVNNTIINGSQVWGGQPVYPQETDDACIFPDGGPCPSGSWSQKRSFVYVWKTW
GQYWQVLGGPVSGLSIGTGRAMLGTHTMEVTVYHRRGSRSYVPLAHSSSAFTITDQVPFSVSVSQLRALDGGNKHFLR
NQPLTFALQLHDPSGYLAEADLSYTWDFGDSSGTLISRALVVTHTYLEPGPVTAQVVLQAAIPLTSCGSSPVPGTTDG
HRPTAEAPNTTAGQVPTTEVVGTTPGQAPTAEPSGTTSVQVPTTEVISTAPVQMPTAESTGMTPEKVPVSEVMGTTLA
EMSTPEATGMTPAEVSIVVLSGTTAAQVTTTEWVETTARELPIPEPEGPDASSIMSTESITGSLGPLLDGTATLRLVK
RQVPLDCVLYRYGSFSVTLDIVQGIESAEILQAVPSGEGDAFELTVSCQGGLPKEACMEISSPGCQPPAQRLCQPVLP
SPACQLVLHQILKGGSGTYCLNVSLADTNSLAVVSTQLIMPGQEAGLGQVPLIVGILLVLMAVVLASLIYRRRLMKQD
FSVPQLPHSSSHWLRLPRIFCSCPIGENSPLLSGQQV MART
MPREDAHFIYGYPKKGHGHSYTTAEEAAGIGILTVILGVLLLIGCWYCRRRNGYRALMDKSLHVGTQCALTRRCPQEG
FDHRDSKVSLQEKNCEPVVPNAPPAYEKLSAEQSPPPYSP TRP-1
PAFLTWHRYHLLRLEKDMQEMLQEPSFSLPYWNFATGKNVCDICTDDLMGSRSNFDSTLISPNSVFSQWRVVCDSLED
YDTLGTLCNSTEDGPIRRNPAGNVARPMVQRLPEPQDVAQCLEVGLFDTPPFYSNSTNSFRNTVEGYSDPTGKYDPAV
RSLHNLAHLFLNGTGGQTHLSSQDPIFVLLHTFTDAVFDEWLRRYNADISTFPLENAPIGHNRQYNMVPFWPPVTNTE
MFVTAPDNLGYTYE Tyros
MLLAVLYCLLWSFQTSAGHFPRACVSSKNLMEKECCPPWSGDRSPCGQLSGRGSCQNILLSNAPLGPQFPFTGVDDRE
SWPSVFYNRTCQCSGNFMGFNCGNCKFGFWGPNCTERRLLVRRNIFDLSAPEKDKFFAYLTLAKHTISSDYVIPIGTY
GQMKNGSTPMFNDINIYDLFVWMHYYVSMDALLGGSEIWRDIDFAHEAPAFLPWHRLFLLRWEQEIQKLTGDENFTIP
YWDWRDAEKCDICTDEYMGGQHPTNPNLLSPASFFSSWQIVCSRLEEYNSHQSLCNGTPEGPLRRNPGNHDKSRTPRL
PSSADVEFCLSLTQYESGSMDKAANFSFRNTLEGFASPLTGIADASQSSMHNALHIYMNGTMSQVQGSANDPIFLLHH
AFVDSIFEQWLQRHRPLQEVYPEANAPIGHNRESYMVPFIPLYRNGDFFISSKDLGYDYSYLQDSDPDSFQDYIKSYL
EQASRIWSWLLGAAMVGAVLTALLAGLVSLLCRHKRKQLPEEKQPLLMEKEDYHSLYQSHL TRP2
MSPLWWGFLLSCLGCKILPGAQGQFPRVCMTVDSLVNKECCPRLGAESANVCGSQQGRGQCTEVRADTRPWSGPYILR
NQDDRELWPRKFFHRTCKCTGNFAGYNCGDCKFGWTGPNCERKKPPVIRQNIHSLSPQEREQFLGALDLAKKRVHPDY
VITTQHWLGLLGPNGTQPQFANCSVYDFFVWLHYYSVRDTLLGPGRPYRAIDFSHQGPAFVTWHRYHLLCLERDLQRL
IGNESFALPYWNFATGRNECDVCTDQLFGAARPDDPTLISRNSRFSSWETVCDSLDDYNHLVTLCNGTYEGLLRRNQM
GRNSMKLPTLKDIRDCLSLQKFDNPPFFQNSTFSFRNALEGFDKADGTLDSQVMSLHNLVHSFLNGTNALPHSAANDP
IFVVLHSFTDAIFDEWMKRFNPPADAWPQELAPIGHNRMYNMVPFFPPVTNEELFLTSDQLGYSYAIDLPVSVEETPG
WPTTLLVVMGTLVALVGLFVLLAFLQYRRLRKGYTPLMETHLSSKRYTEEA MC1R
MAVQGSQRRLLGSLNSTPTAIPQLGLAANQTGARCLEVSISDGLFLSLGLVSLVENALVVATIAKNRNLHSPMYCFIC
CLALSDLLVSGTNVLETAVILLLEAGALVARAAVLQQLDNVIDVITCSSMLSSLCFLGAIAVDRYISIFYALRYHSIV
TLPRAPRAVAAIWVASVVFSTLFIAYYDHVAVLLCLVVFFLAMLVLMAVLYVHMLARACQHAQGIARLHKRQRPVHQG
FGLKGAVTLTILLGIFFLCWGPFFLHLTLIVLCPEHPTCGCIFKNFNLFLALIICNAIIDPLIYAFHSQELRRTLKEV
LTCSW MUC1F
MTPGTQSPFFLLLLLTVLTVVTGSGHASSTPGGEKETSATQRSSVPSSTEKNAVSMTSSVLSSHSPGSGSSTTQGQDV
TLAPATEPASGSAATWGQDVTSVPVTRPALGSTTPPAHDVTSAPDNK

Figure 27

MUC1R
NRPALGSTAPPVHNVTSASGSASGSASTLVHNGTSARATTTPASKSTPFSIPSHHSDTPTTLASHSTKTDASSTHHSS
VPPLTSSNHSTSPQLSTGVSFFFLSFHISNLQFNSSLEDPSTDYYQELQRDISEMPLQIYKQGGFLGLSNIKFRPGSV
VVQLTLAFREGTINVHDVETQFNQYKTEAASRYNLTISDVSVSDVPFPFSAQSGAGVPGWGIALLVLVCVLVALAIVY
LIALAVCQCRRKNYGQLDIFPARDTYHPMSEYPTYHTHGRYVPPSSTDRSPYEKVSAGNGGSSLSYTNPAVAAASANL NB Muc 1 Repeat sequences in the middle of the gene were removed Genes in melanoma specific Savine

BAGE
MAARAVFLALSAQLLQARLMKEESPVVSWRLEPEDGTALCFIF

GAGE-1
MSWRGRSTYRPRPRRYVEPPEMIGPMRPEQFSDEVEPATPEEGEPATQRQDPAAAQEGEDEGASAGQGPKPEADSQEQ
GHPQTGCECEDGPDGQEMDPPNPEEVKTPEEEMRSHYVAQTGILWLLMNNCFLNLSPRKP gp100In4
SWSQKRSFVYVWKTWGEGLPSQPIIHTCVYFFLPDHLSFGRPFHLNFCDFL

MAGE-1
MSLEQRSLHCKPEEALEAQQEALGLVCVQAATSSSSPLVLGTLEEVPTAGSTDPPQSPQGASAFPTTINFTRQRQPSE
GSSSREEEGPSTSCILESLFRAVITKKVADLVGFLLLKYRAREPVTKAEMLESVIKNYKHCFPEIFGKASESLQLVFG
IDVKEADPTGHSYVLVTCLGLSYDGLLGDNQIMPKTGFLIIVLVMIAMEGGHAPEEEIWEELSVMEVYDGREHSAYGE
PRKLLTQDLVQEKYLEYRQVPDSDPARYEFLWGPRALAETSYVKVLEYVIKVSARVRFFFPSLREAALREEEEGV

MAGE-3
MPLEQRSQHCKPEEGLEARGEALGLVGAQAPATEEQEAASSSSTLVEVTLGEVPAAESPDPPQSPQGASSLPTTMNYP
LWSQSYEDSSNQEEEGPSTFPDLESEFQAALSRKVAELVHFLLLKYRAREPVTKAEMLGSVVGNWQYFFPVIFSKASS
SLQLVFGIELMEVDPIGHLYIFATCLGLSYDGLLGDNQIMPKAGLLIIVLAIIAREGDCAPEEKIWEELSVLEVFEGR
EDSILGDPKKLLTQHFVQENYLEYRQVPGSDPACYEFLWGPRALVETSYVKVLHHMVKISGGPHISYPPLHEWVLREG
EE

PRAME
MERRRLWGSIQSRYISMSVWTSPRRLVELAGQSLLKDEALAIAALELLPRELFPPLFMAAFDGRHSQTLKAMVQAWPF
TCLPLGVLMKGQHLHLETFKAVLDGLDVLLAQEVRPRRWKLQVLDLRKNSHQDFWTVWSGNRASLYSFPEPEAAQPMT
KKRKVDGLSTEAEQPFIPVEVLVDLFLKEGACDELFSYLIEKVKRKKNVLRLCCKKLKIFAMPMQDIKMILKMVQLDS
IEDLEVTCTWKLPTLAKFSPYLGQMINLRRLLLSHIHASSYISPEKEEQYIAQFTSQFLSLQCLQALYVDSLFFLRGR
LDQLLRHVMNPLETLSITNCRLSEGDVMHLSQSPSVSQLSVLSLSGVMLTDVSPEPLQALLERASATLQDLVFDECGI
TDDQLLALLPSLSHCSQLTTLSFYGNSISISALQSLLQHLIGLSNLTHVLYPVPLESYEDIHGTLHLERLAYLHARLR
ELLCELGRPSMVWLSANPCPHCGDRTFYDPEPILCPCFMPN

TRP2IN2
LMETHLSSKRYTEEAGGFFPWLKVYYYRFVIGLRVWQWEVISCKLIKRATTRQP

NYNSO1a
MQAEGRGTGGSTGDADGPGGPGIPDGPGGNAGGPGEAGATGGRGPRGAGAARASGPGGGAPRGPHGGAASGLNGCCRC
GARGPESRLLEPYLAMPFATPMEAELARRSLAQDAPPLPVPGVLLKEFTVSGNILTIRLTAADHRQLQLSISSCLQQL
SLLMWITQCFLPVFLAQPPSGQRR

NYNSO1b
MLMAQEALAFLMAQGAMLAAQERRVPRAAEVPGAQGQQGPRGREEAPRGVRMAARLQG

LAGE1

Figure 27 (Cont)

MQAEGQGTGGSTGDADGPGGPGIPDGPGGNAGGPGEAGATGGRGPRGAGAARASGPRGGAPRGPHGGAASAQDGRCPC
GARRPDSRLLQLHITMPFSSPMEAELVRRILSRDAAPLPRPGAVLKDFTVSGNLLFIRLTAADHRQLQLSISSCLQQL
SLLMWITQCFLPVFLAQAPSGQRR

Differentiation Savine Scramble process

```
Disease name      : melanoma
Input filename    : Diffmucg.txt
Output filename   : Diffmucs.txt
Number genes      : 8
Number segments   : 187
Segment length    : 30
Segment overlap   : 15

Segments in original order:
---------------------------
Gene       : gp100
Segment#   : 1
Offset     : 1
1st Codon  : 1
    A  A  M  D  L  V  L  K  R  C  L  L  H  L  A  V  I  G  A  L  L  A  V  G  A  T  K  V  P  R
GCCGCTATGGATCTGGTCC

```
      W   V   N   N   T   I   I   N   G   S   Q   V   W   G   G   Q   P   V   Y   P   Q   E   T   D   D   A   C   I   F   P
    TGGGTCAACAATACCATTATCAATGGCTCCCAGGTCTGGGGAGGCCAACCCGTCTACCCTCAGGAAACCGATGACGCTTGCATTTTCCCT

Gene      : gp100
    Segment#  : 9
    Offset    : 121
    1st Codon : 1
      Q   P   V   Y   P   Q   E   T   D   D   A   C   I   F   P   D   G   G   P   C   P   S   G   S   W   S   Q   K   R   S
    CAGCCTGTGTATCCCCAAGAGACAGACGATGCCTGTATCTTTCCCGATGGCGGACCCTGTCCCTCCGGCTCCTGGTCCCAGAAAAGGTCC Gene      : gp100
    Segment#  : 10
    Offset    : 136
    1st Codon : 1
      D   G   G   P   C   P   S   G   S   W   S   Q   K   R   S   F   V   Y   V   W   K   T   W   G   Q   Y   W   Q   V   L
    GACGGAGGCCCTTGCCCTAGCGGAAGCTGGAGCCAAAAGAGAAGCTTTGTGTATGTGTGGAAGACATGGGGACAGTATTGGCAAGTGCTC Gene      : gp100
    Segment#  : 11
    Offset    : 151
    1st Codon : 1
      F   V   Y   V   W   K   T   W   G   Q   Y   W   Q   V   L   G   G   P   V   S   G   L   S   I   G   T   G   R   A   M
    TTCGTCTACGTCTGGAAAACCTGGGGCCAATACTGGCAGGTCCTGGGAGGCCCTGTGTCCGGCCTCAGCATTGGCACAGGCAGAGCCATG Gene      : gp100
    Segment#  : 12
    Offset    : 166
    1st Codon : 1
      G   G   P   V   S   G   L   S   I   G   T   G   R   A   M   L   G   T   H   T   M   E   V   T   V   Y   H   R   R   G
    GGCGGACCCGTCAGCGGACTGTCCATCGGAACCGGAAGGGCTATGCTCGGCACACACACAATGGAAGTGACAGTGTATCACAGAAGGGGA Gene      : gp100
    Segment#  : 13
    Offset    : 181
    1st Codon : 1
      L   G   T   H   T   M   E   V   T   V   Y   H   R   R   G   S   R   S   Y   V   P   L   A   H   S   S   S   A   F   T
    CTGGGAACCCATACCATGGAGGTCACCGTCTACCATAGGAGAGGCTCCAGGTCCTACGTCCCCCTCGCCCATAGCTCCAGCGCTTTCACA Gene      : gp100
    Segment#  : 14
    Offset    : 196
    1st Codon : 1
      S   R   S   Y   V   P   L   A   H   S   S   S   A   F   T   I   T   D   Q   V   P   F   S   V   S   V   S   Q   L   R
    AGCAGAAGCTATGTGCCTCTGGCTCACTCCAGCTCCGCCTTTACCATTACCGATCAGGTCCCCTTTAGCGTCAGCGTCAGCCAACTGAGA Gene      : gp100
    Segment#  : 15
    Offset    : 211
    1st Codon : 1
      I   T   D   Q   V   P   F   S   V   S   V   S   Q   L   R   A   L   D   G   G   N   K   H   F   L   R   N   Q   P   L
    ATCACAGACCAAGTGCCTTTCTCCGTGTCCGTGTCCCAGCTCAGGGCTCTGGATGGCGGAAACAAACACTTTCTGAGAAACCAACCCCTC Gene      : gp100
    Segment#  : 16
    Offset    : 226
    1st Codon : 1
      A   L   D   G   G   N   K   H   F   L   R   N   Q   P   L   T   F   A   L   Q   L   H   D   P   S   G   Y   L   A   E
    GCCCTCGACGGAGGCAATAAGCATTTCCTCAGGAATCAGCCTCTGACATTCGCTCTGCAACTGCATGACCCTAGCGGATACCTCGCCGAA Gene      : gp100
    Segment#  : 17
    Offset    : 241
    1st Codon : 1
      T   F   A   L   Q   L   H   D   P   S   G   Y   L   A   E   A   D   L   S   Y   T   W   D   F   G   D   S   S   G   T
    ACCTTTGCCCTCCAGCTCCACGATCCCTCCGGCTATCTGGCTGAGGCTGACCTCAGCTATACCTGGGACTTTGGCGATAGCTCCGGCACA Gene      : gp100
    Segment#  : 18
    Offset    : 256
    1st Codon : 1
      A   D   L   S   Y   T   W   D   F   G   D   S   S   G   T   L   I   S   R   A   L   V   V   T   H   T   Y   L   E   P
    GCCGATCTGTCCTACACATGGGATTTCGGAGACTCCAGCGGAACCCTCATCTCCAGGGCTCTGGTCGTGACACACACATACCTCGAGCCT
```

Figure 27 (Cont)

```
Gene       : gp100
Segment#   : 19
Offset     : 271
1st Codon  : 1
   L  I  S  R  A  L  V  V  T  H  T  Y  L  E  P  G  P  V  T  A  Q  V  V  L  Q  A  A  I  P  L
CTGATTAGCAGAGCCCTCGTGGTCACCCATACCTATCTGGAACCCGGACCCGTCACCGCTCAGGTCGTGCTCCAGGCTGCCATTCCCCTC Gene       : gp100
Segment#   : 20
Offset     : 286
1st Codon  : 1
   G  P  V  T  A  Q  V  V  L  Q  A  A  I  P  L  T  S  C  G  S  S  P  V  P  G  T  T  D  G  H
GGCCCTGTGACAGCCCAAGTGGTCCTGCAAGCCGCTATCCCTCTGACAAGCTGTGGCTCCAGCCCTGTGCCTGGCACAACCGATGGCCAT Gene       : gp100
Segment#   : 21
Offset     : 301
1st Codon  : 1
   T  S  C  G  S  S  P  V  P  G  T  T  D  G  H  R  P  T  A  E  A  P  N  T  T  A  G  Q  V  P
ACCTCCTGCGGAAGCTCCCCCGTCCCCGGAACCACAGACGGACACAGACCCACAGCCGAAGCCCCTAACACAACCGCTGGCCAAGTGCCT Gene       : gp100
Segment#   : 22
Offset     : 316
1st Codon  : 1
   R  P  T  A  E  A  P  N  T  T  A  G  Q  V  P  T  T  E  V  V  G  T  T  P  G  Q  A  P  T  A
AGGCCTACCGCTGAGGCTCCCAATACCACAGCCGGACAGGTCCCCACAACCGAAGTGGTCGGCACAACCCCTGGCCAAGCCCCTACCGCT Gene       : gp100
Segment#   : 23
Offset     : 331
1st Codon  : 1
   T  T  E  V  V  G  T  T  P  G  Q  A  P  T  A  E  P  S  G  T  T  S  V  Q  V  P  T  T  E  V
ACCACAGAGGTCGTGGGAACCACACCCGGACAGGCTCCCACAGCCGAACCCTCCGGCACAACCTCCGTGCAAGTGCCTACCACAGAGGTC Gene       : gp100
Segment#   : 24
Offset     : 346
1st Codon  : 1
   E  P  S  G  T  T  S  V  Q  V  P  T  T  E  V  I  S  T  A  P  V  Q  M  P  T  A  E  S  T  G
GAGCCTAGCGGAACCACAAGCGTCCAGGTCCCCACAACCGAAGTGATTAGCACAGCCCCTGTGCAAATGCCTACCGCTGAGTCCACCGGA Gene       : gp100
Segment#   : 25
Offset     : 361
1st Codon  : 1
   I  S  T  A  P  V  Q  M  P  T  A  E  S  T  G  M  T  P  E  K  V  P  V  S  E  V  M  G  T  T
ATCTCCACCGCTCCCGTCCAGATGCCCACAGCCGAAAGCACAGGCATGACCCCTGAGAAAGTGCCTGTGTCCGAGGTCATGGGAACCACA Gene       : gp100
Segment#   : 26
Offset     : 376
1st Codon  : 1
   M  T  P  E  K  V  P  V  S  E  V  M  G  T  T  L  A  E  M  S  T  P  E  A  T  G  M  T  P  A
ATGACACCCGAAAAGGTCCCCCGTCAGCGAAGTGATGGGCACAACCCTCGCCGAAATGTCCACCCCTGAGGCTACCGGAATGACACCCGCT Gene       : gp100
Segment#   : 27
Offset     : 391
1st Codon  : 1
   L  A  E  M  S  T  P  E  A  T  G  M  T  P  A  E  V  S  I  V  V  L  S  G  T  T  A  A  Q  V
CTGGCTGAGATGAGCACACCCGAAGCCACAGGCATGACCCCTGCCGAAGTGTCCATCGTCGTGCTCAGCGGAACCACAGCCGCTCAGGTC Gene       : gp100
Segment#   : 28
Offset     : 406
1st Codon  : 1
   E  V  S  I  V  V  L  S  G  T  T  A  A  Q  V  T  T  T  E  W  V  E  T  T  A  R  E  L  P  I
GAGGTCAGCATTGTGGTCCTGTCCGGCACAACCGCTGCCCAAGTGACAACCACAGAGTGGGTGGAAACCACAGCCAGAGAGCTCCCCATT Gene       : gp100
```

Figure 27 (Cont)

```
Segment#  : 29
Offset    : 421
1st Codon : 1
  T  T  T  E  W  V  E  T  T  A  R  E  L  P  I  P  E  P  E  G  P  D  A  S  S  I  M  S  T  E
ACCACAACCGAATGGGTCGAGACAACCGCTAGGGAACTGCCTATCCCTGAGCCTGAGGGACCCGATGCCTCCAGCATTATGTCCACCGAA Gene      : gp100
Segment#  : 30
Offset    : 436
1st Codon : 1
  P  E  P  E  G  P  D  A  S  S  I  M  S  T  E  S  I  T  G  S  L  G  P  L  L  D  G  T  A  T
CCCGAACCCGAAGGCCCTGACGCTAGCTCCATCATGAGCACAGAGTCCATCACAGGCTCCCTGGGACCCCTCCTGGATGGCACAGCCACA Gene      : gp100
Segment#  : 31
Offset    : 451
1st Codon : 1
  S  I  T  G  S  L  G  P  L  L  D  G  T  A  T  L  R  L  V  K  R  Q  V  P  L  D  C  V  L  Y
AGCATTACCGGAAGCCTCGGCCCTCTGCTCGACGGAACCGCTACCCTCAGGCTCGTGAAAAGGCAAGTGCCTCTGGATTGCGTCCTGTAT Gene      : gp100
Segment#  : 32
Offset    : 466
1st Codon : 1
  L  R  L  V  K  R  Q  V  P  L  D  C  V  L  Y  R  Y  G  S  F  S  V  T  L  D  I  V  Q  G  I
CTGAGACTGGTCAAGAGACAGGTCCCCCTCGACTGTGTGCTCTACAGATACGGAAGCTTTAGCGTCACCCTCGACATTGTGCAAGGCATT Gene      : gp100
Segment#  : 33
Offset    : 481
1st Codon : 1
  R  Y  G  S  F  S  V  T  L  D  I  V  Q  G  I  E  S  A  E  I  L  Q  A  V  P  S  G  E  G  D
AGGTATGGCTCCTTCTCCGTGACACTGGATATCGTCCAGGGAATCGAAAGCGCTGAGATTCTGCAAGCCGTCCCCTCCGGCGAAGGCGAT Gene      : gp100
Segment#  : 34
Offset    : 496
1st Codon : 1
  E  S  A  E  I  L  Q  A  V  P  S  G  E  G  D  A  F  E  L  T  V  S  C  Q  G  G  L  P  K  E
GAGTCCGCCGAAATCCTCCAGGCTGTGCCTAGCGGAGAGGGAGACGCTTTCGAACTGACAGTGTCCTGCCAAGGCGGACTGCCTAAGGAA Gene      : gp100
Segment#  : 35
Offset    : 511
1st Codon : 1
  A  F  E  L  T  V  S  C  Q  G  G  L  P  K  E  A  C  M  E  I  S  S  P  G  C  Q  P  P  A  Q
GCCTTTGAGCTCACCGTCAGCTGTCAGGGAGGCCTCCCCAAAGAGGCTTGCATGGAGATTAGCTCCCCCGGATGCCAACCCCCTGCCCAA Gene      : gp100
Segment#  : 36
Offset    : 526
1st Codon : 1
  A  C  M  E  I  S  S  P  G  C  Q  P  P  A  Q  R  L  C  Q  P  V  L  P  S  P  A  C  Q  L  V
GCCTGTATGGAAATCTCCAGCCCTGGCTGTCAGCCTCCCGCTCAGAGACTGTGTCAGCCTGTGCTCCCCTCCCCCGCTTGCCAACTGGTC Gene      : gp100
Segment#  : 37
Offset    : 541
1st Codon : 1
  R  L  C  Q  P  V  L  P  S  P  A  C  Q  L  V  L  H  Q  I  L  K  G  G  S  G  T  Y  C  L  N
AGGCTCTGCCAACCCGTCCTGCCTAGCCCTGCCTGTCAGCTCGTGCTCCACCAAATCCTCAAGGGAGGCTCCGGCACATACTGTCTGAAT Gene      : gp100
Segment#  : 38
Offset    : 556
1st Codon : 1
  L  H  Q  I  L  K  G  G  S  G  T  Y  C  L  N  V  S  L  A  D  T  N  S  L  A  V  V  S  T  Q
CTGCATCAGATTCTGAAAGGCGGAAGCGGAACCTATTGCCTCAACGTCAGCCTCGCCGATACCAATAGCCTCGCCGTCGTGTCCACCCAA Gene      : gp100
Segment#  : 39
Offset    : 571
```

Figure 27 (Cont)

```
1st Codon : 1
  V  S  L  A  D  T  N  S  L  A  V  V  S  T  Q  L  I  M  P  G  Q  E  A  G  L  G  Q  V  P  L
GTGTCCCTGGCTGACACAAACTCCCTGGCTGTGGTCAGCACACAGCTCATCATGCCCGGACAGGAAGCCGGACTGGGACAGGTCCCCCTC Gene      : gp100
Segment#  : 40
Offset    : 586
1st Codon : 1
  L  I  M  P  G  Q  E  A  G  L  G  Q  V  P  L  I  V  G  I  L  L  V  L  M  A  V  V  L  A  S
CTGATTATGCCTGGCCAAGAGGCTGGCCTCGGCCAAGTGCCTCTGATTGTGGGAATCCTCCTGGTCCTGATGGCCGTCGTGCTCGCCTCC Gene      : gp100
Segment#  : 41
Offset    : 601
1st Codon : 1
  I  V  G  I  L  L  V  L  M  A  V  V  L  A  S  L  I  Y  R  R  R  L  M  K  Q  D  F  S  V  P
ATCGTCGGCATTCTGCTCGTGCTCATGGCTGTGGTCCTGGCTAGCCTCATCTATAGGAGAAGGCTCATGAAACAGGATTTCTCCGTGCCT Gene      : gp100
Segment#  : 42
Offset    : 616
1st Codon : 1
  L  I  Y  R  R  R  L  M  K  Q  D  F  S  V  P  Q  L  P  H  S  S  S  H  W  L  R  L  P  R  I
CTGATTTACAGAAGGAGACTGATGAAGCAAGACTTTAGCGTCCCCCAACTGCCTCACTCCAGCTCCCACTGGCTGAGACTGCCTAGGATT Gene      : gp100
Segment#  : 43
Offset    : 631
1st Codon : 1
  Q  L  P  H  S  S  S  H  W  L  R  L  P  R  I  F  C  S  C  P  I  G  E  N  S  P  L  L  S  G
CAGCTCCCCCATAGCTCCAGCCATTGGCTCAGGCTCCCCAGAATCTTTTGCTCCTGCCCTATCGGAGAGAATAGCCCTCTGCTCAGCGGA Gene      : gp100
Segment#  : 44
Offset    : 646
1st Codon : 1
  F  C  S  C  P  I  G  E  N  S  P  L  L  S  G  Q  Q  V  A  A
TTCTGTAGCTGTCCCATTGGCGAAAACTCCCCCCTCCTGTCCGGCCAACAGGTCGCCGCT Gene      : MART
Segment#  : 1
Offset    : 1
1st Codon : 1
  A  A  M  P  R  E  D  A  H  F  I  Y  G  Y  P  K  K  G  H  G  H  S  Y  T  T  A  E  E  A  A
GCCGCTATGCCTAGGGAAGACGCTCACTTTATCTATGGCTATCCCAAAAAGGGACACGGACACTCCTACACAACCGCTGAGGAAGCCGCT Gene      : MART
Segment#  : 2
Offset    : 16
1st Codon : 1
  K  K  G  H  G  H  S  Y  T  T  A  E  E  A  A  G  I  G  I  L  T  V  I  L  G  V  L  L  L  I
AAGAAAGGCCATGGCCATAGCTATACCACAGCCGAAGAGGCTGCCGGAATCGGAATCCTCACCGTCATCCTCGGCGTCCTGCTCCTGATT Gene      : MART
Segment#  : 3
Offset    : 31
1st Codon : 1
  G  I  G  I  L  T  V  I  L  G  V  L  L  L  I  G  C  W  Y  C  R  R  R  N  G  Y  R  A  L  M
GGCATTGGCATTCTGACAGTGATTCTGGGAGTGCTCCTGCTCATCGGATGCTGGTACTGTAGGAGAAGGAATGGCTATAGGGCTCTGATG Gene      : MART
Segment#  : 4
Offset    : 46
1st Codon : 1
  G  C  W  Y  C  R  R  R  N  G  Y  R  A  L  M  D  K  S  L  H  V  G  T  Q  C  A  L  T  R  R
GGCTGTTGGTATTGCAGAAGGAGAAACGGATACAGAGCCCTCATGGATAAGTCCCTGCATGTGGGAACCCAATGCGCTCTGACAAGGAGA Gene      : MART
Segment#  : 5
Offset    : 61
1st Codon : 1
  D  K  S  L  H  V  G  T  Q  C  A  L  T  R  R  C  P  Q  E  G  F  D  H  R  D  S  K  V  S  L
```

Figure 27 (Cont)

```
GACAAAAGCCTCCACGTCGGCACACAGTGTGCCCTCACCAGAAGGTGTCCCCAAGAGGGATTCGATCACAGAGACTCCAAGGTCAGCCTC

Gene      : MART
Segment#  : 6
Offset    : 76
1st Codon : 1
 C   P   Q   E   G   F   D   H   R   D   S   K   V   S   L   Q   E   K   N   C   E   P   V   V   P   N   A   P   P   A
TGCCCTCAGGAAGGCTTTGACCATAGGGATAGCAAAGTGTCCCTGCAAGAGAAAAACTGTGAGCCTGTGGTCCCCAATGCCCCTCCCGCT Gene      : MART
Segment#  : 7
Offset    : 91
1st Codon : 1
 Q   E   K   N   C   E   P   V   V   P   N   A   P   P   A   Y   E   K   L   S   A   E   Q   S   P   P   P   Y   S   P
CAGGAAAAGAATTGCGAACCCGTCGTGCCTAACGCTCCCCCTGCCTATGAGAAACTGTCCGCCGAACAGTCCCCCCCTCCCTATAGCCCT Gene      : MART
Segment#  : 8
Offset    : 106
1st Codon : 1
 Y   E   K   L   S   A   E   Q   S   P   P   P   Y   S   P   A   A
TACGAAAAGCTCAGCGCTGAGCAAAGCCCTCCCCCTTACTCCCCCGCTGCC Gene      : TRP-1
Segment#  : 1
Offset    : 1
1st Codon : 1
 A   A   P   A   F   L   T   W   H   R   Y   H   L   L   R   L   E   K   D   M   Q   E   M   L   Q   E   P   S , F   S
GCCGCTCCCGCTTTCCTCACCTGGCACAGATACCATCTGCTCAGGCTCGAGAAAGACATGCAGGAAATGCTCCAGGAACCCTCCTTCTCC Gene      : TRP-1
Segment#  : 2
Offset    : 16
1st Codon : 1
 L   E   K   D   M   Q   E   M   L   Q   E   P   S   F   S   L   P   Y   W   N   F   A   T   G   K   N   V   C   D   I
CTGGAAAAGGATATGCAAGAGATGCTGCAAGAGCCTAGCTTTAGCCTCCCCTATTGGAATTTCGCTACCGGAAAGAATGTGTGTGACATT Gene      : TRP-1
Segment#  : 3
Offset    : 31
1st Codon : 1
 L   P   Y   W   N   F   A   T   G   K   N   V   C   D   I   C   T   D   D   L   M   G   S   R   S   N   F   D   S   T
CTGCCTTACTGGAACTTTGCCACAGGCAAAAACGTCTGCGATATCTGTACCGATGACCTCATGGGAAGCAGAAGCAATTTCGATAGCACA Gene      : TRP-1
Segment#  : 4
Offset    : 46
1st Codon : 1
 C   T   D   D   L   M   G   S   R   S   N   F   D   S   T   L   I   S   P   N   S   V   F   S   Q   W   R   V   V   C
TGCACAGACGATCTGATGGGCTCCAGGTCCAACTTTGACTCCACCCTCATCTCCCCAATAGCGTCTTCTCCCAGTGGAGGGTCGTGTGT Gene      : TRP-1
Segment#  : 5
Offset    : 61
1st Codon : 1
 L   I   S   P   N   S   V   F   S   Q   W   R   V   V   C   D   S   L   E   D   Y   D   T   L   G   T   L   C   N   S
CTGATTAGCCCTAACTCCGTGTTTAGCCAATGGAGAGTGGTCTGCGATAGCCTCGAGGATTACGATACCCTCGGCACACTGTGTAACTCC Gene      : TRP-1
Segment#  : 6
Offset    : 76
1st Codon : 1
 D   S   L   E   D   Y   D   T   L   G   T   L   C   N   S   T   E   D   G   P   I   R   R   N   P   A   G   N   V   A
GACTCCCTGGAAGACTATGACACACTGGGAACCCTCTGCAATAGCACAGAGGATGGCCCTATCAGAAGGAATCCCGCTGGCAATGTGGCT Gene      : TRP-1
Segment#  : 7
Offset    : 91
1st Codon : 1
 T   E   D   G   P   I   R   R   N   P   A   G   N   V   A   R   P   M   V   Q   R   L   P   E   P   Q   D   V   A   Q
ACCGAAGACGGACCCATTAGGAGAAACCCTGCCGGAAACGTCGCCAGACCCATGGTGCAAAGGCTCCCCGAACCCCAAGACGTCGCCCAA
```

Figure 27 (Cont)

```
Gene      : TRP-1
Segment#  : 8
Offset    : 106
1st Codon : 1
   R  P  M  V  Q  R  L  P  E  P  Q  D  V  A  Q  C  L  E  V  G  L  F  D  T  P  P  F  Y  S  N
AGGCCTATGGTCCAGAGACTGCCTGAGCCTCAGGATGTGGCTCAGTGTCTGGAAGTGGGACTGTTTGACACACCCCCTTTCTATAGCAAT Gene      : TRP-1
Segment#  : 9
Offset    : 121
1st Codon : 1
   C  L  E  V  G  L  F  D  T  P  P  F  Y  S  N  S  T  N  S  F  R  N  T  V  E  G  Y  S  D  P
TGCCTCGAGGTCGGCCTCTTCGATACCCCTCCCTTTTACTCCAACTCCACCAATAGCTTTAGGAATACCGTCGAGGGATACTCCGACCCT Gene      : TRP-1
Segment#  : 10
Offset    : 136
1st Codon : 1
   S  T  N  S  F  R  N  T  V  E  G  Y  S  D  P  T  G  K  Y  D  P  A  V  R  S  L  H  N  L  A
AGCACAAACTCCTTCAGAAACACAGTGGAAGGCTATAGCGATCCCACAGGCAAATACGATCCCGCTGTGAGAAGCCTCCACAATCTGGCT Gene      : TRP-1
Segment#  : 11
Offset    : 151
1st Codon : 1
   T  G  K  Y  D  P  A  V  R  S  L  H  N  L  A  H  L  F  L  N  G  T  G  G  Q  T  H  L  S  S
ACCGGAAAGTATGACCCTGCCGTCAGGTCCCTGCATAACCTCGCCCATCTGTTTCTGAATGGCACAGGCGGACAGACACACCTCAGCTCC Gene      : TRP-1
Segment#  : 12
Offset    : 166
1st Codon : 1
   H  L  F  L  N  G  T  G  G  Q  T  H  L  S  S  Q  D  P  I  F  V  L  L  H  T  F  T  D  A  V
CACCTCTTCCTCAACGGAACCGGAGGCCAAACCCATCTGTCCAGCCAAGACCCTATCTTTGTGCTCCTGCATACCTTTACCGATGCCGTC Gene      : TRP-1
Segment#  : 13
Offset    : 181
1st Codon : 1
   Q  D  P  I  F  V  L  L  H  T  F  T  D  A  V  F  D  E  W  L  R  R  Y  N  A  D  I  S  T  F
CAGGATCCCATTTTCGTCCTGCTCCACACATTCACAGACGCTGTGTTTGACGAATGGCTCAGGAGATACAATGCCGATATCTCCACCTTT Gene      : TRP-1
Segment#  : 14
Offset    : 196
1st Codon : 1
   F  D  E  W  L  R  R  Y  N  A  D  I  S  T  F  P  L  E  N  A  P  I  G  H  N  R  Q  Y  N  M
TTCGATGAGTGGCTGAGAAGGTATAACGCTGACATTAGCACATTCCCTCTGGAAAACGCTCCCATTGGCCATAACAGACAGTATAACATG Gene      : TRP-1
Segment#  : 15
Offset    : 211
1st Codon : 1
   P  L  E  N  A  P  I  G  H  N  R  Q  Y  N  M  V  P  F  W  P  P  V  T  N  T  E  M  F  V  T
CCCCTCGAGAATGCCCCTATCGGACACAATAGGCAATACAATATGGTCCCCTTTTGGCCTCCCGTCACCAATACCGAAATGTTTGTGACA Gene      : TRP-1
Segment#  : 16
Offset    : 226
1st Codon : 1
   V  P  F  W  P  P  V  T  N  T  E  M  F  V  T  A  P  D  N  L  G  Y  T  Y  E  A  A
GTGCCTTTCTGGCCCCCTGTGACAAACACAGAGATGTTCGTCACCGCTCCCGATAACCTCGGCTATACCTATGAGGCTGCC Gene      : Tyros
Segment#  : 1
Offset    : 1
1st Codon : 1
   A  A  M  L  L  A  V  L  Y  C  L  L  W  S  F  Q  T  S  A  G  H  F  P  R  A  C  V  S  S  K
GCCGCTATGCTCCTGGCTGTGCTCTACTGTCTGCTCTGGTCCTTCCAAACCTCCGCCGGACACTTTCCCAGAGCCTGTGTGTCCAGCAAA Gene      : Tyros
Segment#  : 2
```

Figure 27 (Cont)

```
Offset    : 16
1st Codon : 1
  Q  T  S  A  G  H  F  P  R  A  C  V  S  S  K  N  L  M  E  K  E  C  C  P  P  W  S  G  D  R
CAGACAAGCGCTGGCCATTTCCCTAGGGCTTGCGTCAGCTCCAAGAATCTGATGGAGAAAGAGTGTTGCCCTCCCTGGAGCGGAGACAGA Gene      : Tyros
Segment#  : 3
Offset    : 31
1st Codon : 1
  N  L  M  E  K  E  C  C  P  P  W  S  G  D  R  S  P  C  G  Q  L  S  G  R  G  S  C  Q  N  I
AACCTCATGGAAAAGGAATGCTGTCCCCCTTGGTCCGGCGATAGGTCCCCCTGTGGCCAACTGTCCGGCAGAGGCTCCTGCCAAAACATT Gene      : Tyros
Segment#  : 4
Offset    : 46
1st Codon : 1
  S  P  C  G  Q  L  S  G  R  G  S  C  Q  N  I  L  L  S  N  A  P  L  G  P  Q  F  P  P  T  G
AGCCCTTGCGGACAGCTCAGCGGAAGGGGAAGCTGTCAGAATATCCTCCTGTCCAACGCTCCCCTCGGCCCTCAGTTTCCCTTTACCGGA Gene      : Tyros
Segment#  : 5
Offset    : 61
1st Codon : 1
  L  L  S  N  A  P  L  G  P  Q  F  P  P  T  G  V  D  D  R  E  S  W  P  S  V  F  Y  N  R  T
CTGCTCAGCAATGCCCCTCTGGGACCCCAATTCCCTTTCACAGGCGTCGACGATAGGGAAAGCTGGCCCTCCGTGTTTTACAATAGGACA Gene      : Tyros
Segment#  : 6
Offset    : 76
1st Codon : 1
  V  D  D  R  E  S  W  P  S  V  F  Y  N  R  T  C  Q  C  S  G  N  F  M  G  F  N  C  G  N  C
GTGGATGACAGAGAGTCCTGGCCTAGCGTCTTCTATAACAGAACCTGTCAGTGTAGCGGAAACTTTATGGGATTCAATTGCGGAAACTGT Gene      : Tyros
Segment#  : 7
Offset    : 91
1st Codon : 1
  C  Q  C  S  G  N  F  M  G  F  N  C  G  N  C  K  F  G  F  W  G  P  N  C  T  E  R  R  L  L
TGCCAATGCTCCGGCAATTTCATGGGCTTTAACTGTGGCAATTGCAAATTCGGATTCTGGGGCCCTAACTGTACCGAAAGGAGACTGCTC Gene      : Tyros
Segment#  : 8
Offset    : 106
1st Codon : 1
  K  F  G  F  W  G  P  N  C  T  E  R  R  L  L  V  R  R  N  I  F  D  L  S  A  P  E  K  D  K
AAGTTTGGCTTTTGGGGACCCAATTGCACAGAGAGAAGGCTCCTGGTCAGGAGAAACATTTTCGATCTGTCCGCCCCTGAGAAAGACAAA Gene      : Tyros
Segment#  : 9
Offset    : 121
1st Codon : 1
  V  R  R  N  I  F  D  L  S  A  P  E  K  D  K  F  F  A  Y  L  T  L  A  K  H  T  I  S  S  D
GTGAGAAGGAATATCTTTGACCTCAGCGCTCCCGAAAAGGATAAGTTTTTCGCTTACCTCACCCTCGCCAAACACACAATCTCCAGCGAT Gene      : Tyros
Segment#  : 10
Offset    : 136
1st Codon : 1
  F  F  A  Y  L  T  L  A  K  H  T  I  S  S  D  Y  V  I  P  I  G  T  Y  G  Q  M  K  N  G  S
TTCTTTGCCTATCTGACACTGGCTAAGCATACCATTAGCTCCGACTATGTGATTCCCATTGGCACATACGGACAGATGAAGAATGGCTCC Gene      : Tyros
Segment#  : 11
Offset    : 151
1st Codon : 1
  Y  V  I  P  I  G  T  Y  G  Q  M  K  N  G  S  T  P  M  F  N  D  I  N  I  Y  D  L  F  V  W
TACGTCATCCCTATCGGAACCTATGGCCAAATGAAAAACGGAAGCACACCCATGTTCAATGACATTAACATTTACGATCTGTTTGTGTGG Gene      : Tyros
Segment#  : 12
Offset    : 166
1st Codon : 1
```

Figure 27 (Cont)

```
           T  P  M  F  N  D  I  N  I  Y  D  L  F  V  W  M  H  Y  Y  V  S  M  D  A  L  L  G  G  S  E
         ACCCCTATGTTTAACGATATCAATATCTATGACCTCTTCGTCTGGATGCACTATTACGTCAGCATGGACGCTCTGCTCGGCGGAAGCGAA

Gene      : Tyros
Segment#  : 13
Offset    : 181
1st Codon : 1
           M  H  Y  Y  V  S  M  D  A  L  L  G  G  S  E  I  W  R  D  I  D  F  A  H  E  A  P  A  F  L
         ATGCATTACTATGTGTCCATGGATGCCCTCCTGGGAGGCTCCGAGATTTGGAGAGACATTGACTTTGCCCATGAGGCTCCCGCTTTCCTC Gene      : Tyros
Segment#  : 14
Offset    : 196
1st Codon : 1
           I  W  R  D  I  D  F  A  H  E  A  P  A  F  L  P  W  H  R  L  F  L  L  R  W  E  Q  E  I  Q
         ATCTGGAGGGATATCGATTTCGCTCACGAAGCCCCTGCCTTTCTGCCTTGGCATAGGCTCTTCCTCCTGAGATGGGAACAGGAAATCCAA Gene      : Tyros
Segment#  : 15
Offset    : 211
1st Codon : 1
           P  W  H  R  L  F  L  L  R  W  E  Q  E  I  Q  K  L  T  G  D  E  N  F  T  I  P  Y  W  D  W
         CCCTGGCACAGACTGTTTCTGCTCAGGTGGGAGCAAGAGATTCAGAAACTGACAGGCGATGAGAATTTCACAATCCCTTACTGGGACTGG Gene      : Tyros
Segment#  : 16
Offset    : 226
1st Codon : 1
           K  L  T  G  D  E  N  F  T  I  P  Y  W  D  W  R  D  A  E  K  C  D  I  C  T  D  E  Y  M  G
         AAGCTCACCGGAGACGAAAAACTTTACCATTCCCTATTGGGATTGGAGAGACGCTGAGAAATGCGATATCTGTACCGATGAGTATATGGGA Gene      : Tyros
Segment#  : 17
Offset    : 241
1st Codon : 1
           R  D  A  E  K  C  D  I  C  T  D  E  Y  M  G  G  Q  H  P  T  N  P  N  L  L  S  P  A  S  F
         AGGGATGCCGAAAAGTGTGACATTTGCACAGACGAATACATGGGCGGACAGCATCCCACAAACCCTAACCTCCTGTCCCCCGCTAGCTTT Gene      : Tyros
Segment#  : 18
Offset    : 256
1st Codon : 1
           G  Q  H  P  T  N  P  N  L  L  S  P  A  S  F  F  S  S  W  Q  I  V  C  S  R  L  E  E  Y  N
         GGCCAACACCCTACCAATCCCAATCTGCTCAGCCCTGCCTCCTTCTTTAGCTCCTGGCAAATCGTCTGCTCCAGGCTCGAGGAATACAAT Gene      : Tyros
Segment#  : 19
Offset    : 271
1st Codon : 1
           F  S  S  W  Q  I  V  C  S  R  L  E  E  Y  N  S  H  Q  S  L  C  N  G  T  P  E  G  P  L  R
         TTCTCCAGCTGGCAGATTGTGTGTAGCAGACTGGAAGAGTATAACTCCCACCAAAGCCTCTGCAATGGCACACCCGAAGGCCCTCTGAGA Gene      : Tyros
Segment#  : 20
Offset    : 286
1st Codon : 1
           S  H  Q  S  L  C  N  G  T  P  E  G  P  L  R  R  N  P  G  N  H  D  K  S  R  T  P  R  L  P
         AGCCATCAGTCCCTGTGTAACGGAACCCCTGAGGGACCCCTCAGGAGAAACCCTGGCAATCACGATAAGTCCAGGACACCCAGACTGCCT Gene      : Tyros
Segment#  : 21
Offset    : 301
1st Codon : 1
           R  N  P  G  N  H  D  K  S  R  T  P  R  L  P  S  S  A  D  V  E  F  C  L  S  L  T  Q  Y  E
         AGGAATCCCGGAAACCATGACAAAAGCAGAACCCCTAGGCTCCCCTCCAGCGCTGACGTCGAGTTTTGCCTCAGCCTCACCCAATACGAA Gene      : Tyros
Segment#  : 22
Offset    : 316
1st Codon : 1
           S  S  A  D  V  E  F  C  L  S  L  T  Q  Y  E  S  G  S  M  D  K  A  A  N  F  S  F  R  N  T
         AGCTCCGCCGATGTGGAATTCTGTCTGTCCCTGACACAGTATGAGTCCGGCTCCATGGATAAGGCTGCCAATTTCTCCTTCAGAAACACA
```

Figure 27 (Cont)

```
Gene      : Tyros
Segment#  : 23
Offset    : 331
1st Codon : 1
  S  G  S  M  D  K  A  A  N  F  S  F  R  N  T  L  E  G  F  A  S  P  L  T  G  I  A  D  A  S
AGCGGAAGCATGGACAAAGCCGCTAACTTTAGCTTTAGGAATACCCTCGAGGGATTCGCTAGCCCTCTGACAGGCATTGCCGATGCCTCC Gene      : Tyros
Segment#  : 24
Offset    : 346
1st Codon : 1
  L  E  G  F  A  S  P  L  T  G  I  A  D  A  S  Q  S  S  M  H  N  A  L  H  I  Y  M  N  G  T
CTGGAAGGCTTTGCCTCCCCCCTCACCGGAATCGCTGACGCTAGCCAAAGCTCCATGCATAACGCTCTGCATATCTATATGAATGGCACA Gene      : Tyros
Segment#  : 25
Offset    : 361
1st Codon : 1
  Q  S  S  M  H  N  A  L  H  I  Y  M  N  G  T  M  S  Q  V  Q  G  S  A  N  D  P  I  F  L  L
CAGTCCAGCATGCACAATGCCCTCCACATTTACATGAACGGAACCATGAGCCAAGTGCAAGGCTCCGCCAATGACCCTATCTTTCTGCTC Gene      : Tyros
Segment#  : 26
Offset    : 376
1st Codon : 1
  M  S  Q  V  Q  G  S  A  N  D  P  I  F  L  L  H  H  A  F  V  D  S  I  F  E  Q  W  L  Q  R
ATGTCCCAGGTCCAGGGAAGCGCTAACGATCCCATTTTCCTCCTGCATCACGCTTTCGTCGACTCCATCTTTGAGCAATGGCTCCAGAGA Gene      : Tyros
Segment#  : 27
Offset    : 391
1st Codon : 1
  H  H  A  F  V  D  S  I  F  E  Q  W  L  Q  R  H  R  P  L  Q  E  V  Y  P  E  A  N  A  P  I
CACCATGCCTTTGTGGATAGCATTTTCGAACAGTGGCTGCAAAGGCATAGGCCTCTGCAAGAGGTCTACCCTGAGGCTAACGCTCCCATT Gene      : Tyros
Segment#  : 28
Offset    : 406
1st Codon : 1
  H  R  P  L  Q  E  V  Y  P  E  A  N  A  P  I  G  H  N  R  E  S  Y  M  V  P  F  I  P  L  Y
CACAGACCCCTCCAGGAAGTGTATCCCGAAGCCAATGCCCCTATCGGACACAATAGGGAAAGCTATATGGTCCCCTTTATCCCTCTGTAT Gene      : Tyros
Segment#  : 29
Offset    : 421
1st Codon : 1
  G  H  N  R  E  S  Y  M  V  P  F  I  P  L  Y  R  N  G  D  F  F  I  S  S  K  D  L  G  Y  D
GGCCATAACAGAGAGTCCTACATGGTGCCTTTCATTCCCCTCTACAGAAACGGAGACTTTTTCATTAGCTCCAAGGATCTGGGATACGAT Gene      : Tyros
Segment#  : 30
Offset    : 436
1st Codon : 1
  R  N  G  D  F  F  I  S  S  K  D  L  G  Y  D  Y  S  Y  L  Q  D  S  D  P  D  S  F  Q  D  Y
AGGAATGGCGATTTCTTTATCTCCAGCAAAGACCTCGGCTATGACTATAGCTATCTGCAAGACTCCGACCCTGACTCCTTCCAAGACTAT Gene      : Tyros
Segment#  : 31
Offset    : 451
1st Codon : 1
  Y  S  Y  L  Q  D  S  D  P  D  S  F  Q  D  Y  I  K  S  Y  L  E  Q  A  S  R  I  W  S  W  L
TACTCCTACCTCCAGGATAGCGATCCCGATAGCTTTCAGGATTACATTAAGTCCTACCTCGAGCAAGCCTCCAGGATTTGGTCCTGGCTC Gene      : Tyros
Segment#  : 32
Offset    : 466
1st Codon : 1
  I  K  S  Y  L  E  Q  A  S  R  I  W  S  W  L  L  G  A  A  M  V  G  A  V  L  T  A  L  L  A
ATCAAAAGCTATCTGGAACAGGCTAGCAGAATCTGGAGCTGGCTGCTCGGCGCTGCCATGGTGGGAGCCGTCCTGACAGCCCTCCTGGCT Gene      : Tyros
```

Figure 27 (Cont)

```
Segment#  : 33
Offset    : 481
1st Codon : 1
   L   G   A   A   M   V   G   A   V   L   T   A   L   L   A   G   L   V   S   L   L   C   R   H   K   R   K   Q   L   P
CTGGGAGCCGCTATGGTCGGCGCTGTGCTCACCGCTCTGCTCGCCGGACTGGTCAGCCTCCTGTGTAGGCATAAGAGAAAGCAACTGCCT Gene      : Tyros
Segment#  : 34
Offset    : 496
1st Codon : 1
   G   L   V   S   L   L   C   R   H   K   R   K   Q   L   P   E   E   K   Q   P   L   L   M   E   K   E   D   Y   H   S
GGCCTCGTGTCCCTGCTCTGCAGACACAAAAGGAAACAGCTCCCCGAAGAGAAACAGCCTCTGCTCATGGAAAAGGAAGACTATCACTCC Gene      : Tyros
Segment#  : 35
Offset    : 511
1st Codon : 1
   E   E   K   Q   P   L   L   M   E   K   E   D   Y   H   S   L   Y   Q   S   H   L   A   A
GAGGAAAAGCAACCCCTCCTGATGGAGAAAGAGGATTACCATAGCCTCTACCAAAGCCATCTGGCTGCC Gene      : TRP2
Segment#  : 1
Offset    : 1
1st Codon : 1
   A   A   M   S   P   L   W   W   G   F   L   L   S   C   L   G   C   K   I   L   P   G   A   Q   G   Q   F   P   R   V
GCCGCTATGTCCCCCCTCTGGTGGGGCTTTCTGCTCAGCTGTCTGGGATGCAAAATCCTCCCCGGAGCCCAAGGCCAATTCCCTAGGGTC Gene      : TRP2
Segment#  : 2
Offset    : 16
1st Codon : 1
   G   C   K   I   L   P   G   A   Q   G   Q   F   P   R   V   C   M   T   V   D   S   L   V   N   K   E   C   C   P   R
GGCTGTAAGATTCTGCCTGGCGCTCAGGGACAGTTTCCCAGAGTGTGTATGACAGTGGATAGCCTCGTGAATAAGGAATGCTGTCCCAGA Gene      : TRP2
Segment#  : 3
Offset    : 31
1st Codon : 1
   C   M   T   V   D   S   L   V   N   K   E   C   C   P   R   L   G   A   E   S   A   N   V   C   G   S   Q   Q   G   R
TGCATGACCGTCGACTCCCTGGTCAACAAAGAGTGTTGCCCTAGGCTCGGCGCTGAGTCCGCCAATGTGTGTGGCTCCCAGCAAGGCAGA Gene      : TRP2
Segment#  : 4
Offset    : 46
1st Codon : 1
   L   G   A   E   S   A   N   V   C   G   S   Q   Q   G   R   G   Q   C   T   E   V   R   A   D   T   R   P   W   S   G
CTGGGAGCCGAAAGCGCTAACGTCTGCGGAAGCCAACAGGGAAGGGGACAGTGTACCGAAGTGAGAGCCGATACCAGACCCTGGAGCGGA Gene      : TRP2
Segment#  : 5
Offset    : 61
1st Codon : 1
   G   Q   C   T   E   V   R   A   D   T   R   P   W   S   G   P   Y   I   L   R   N   Q   D   D   R   E   L   W   P   R
GGCCAATGCACAGAGGTCAGGGCTGACACAAGGCCTTGGTCCGGCCCTTACATTCTGAGAAACCAAGACGATAGGGAACTGTGGCCCAGA Gene      : TRP2
Segment#  : 6
Offset    : 76
1st Codon : 1
   P   Y   I   L   R   N   Q   D   D   R   E   L   W   P   R   K   F   F   H   R   T   C   K   C   T   G   N   F   A   G
CCCTATATCCTCAGGAATCAGGATGACAGAGAGCTCTGGCCTAGGAAATTCTTTCACAGAACCTGTAAGTGTACCGGAAACTTTGCCGGA Gene      : TRP2
Segment#  : 7
Offset    : 91
1st Codon : 1
   K   F   F   H   R   T   C   K   C   T   G   N   F   A   G   Y   N   C   G   D   C   K   F   G   W   T   G   P   N   C
AAGTTTTTCCATAGGACATGCAAATGCACAGGCAATTTCGCTGGCTATAACTGTGGCGATTGCAAATTCGGATGGACAGGCCCTAACTGT Gene      : TRP2
Segment#  : 8
Offset    : 106
```

```
1st Codon : 1
     Y   N   C   G   D   C   K   F   G   W   T   G   P   N   C   E   R   K   K   P   P   V   I   R   Q   N   I   H   S   L
    TACAATTGCGGAGACTGTAAGTTTGGCTGGACCGGACCCAATTGCGAAAGGAAAAAGCCTCCCGTCATCAGACAGAATATCCATAGCCTC Gene      : TRP2
Segment#  : 9
Offset    : 121
1st Codon : 1
     E   R   K   K   P   P   V   I   R   Q   N   I   H   S   L   S   P   Q   E   R   E   Q   F   L   G   A   L   D   L   A
    GAGAGAAAGAAACCCCCTGTGATTAGGCAAAACATTCACTCCCTGTCCCCCAAGAGAGAGAGCAATTCCTCGGCGCTCTGGATCTGGCT Gene      : TRP2
Segment#  : 10
Offset    : 136
1st Codon : 1
     S   P   Q   E   R   E   Q   F   L   G   A   L   D   L   A   K   K   R   V   H   P   D   Y   V   I   T   T   Q   H   W
    AGCCCTCAGGAAAGGGAACAGTTTCTGGGAGCCCTCGACCTCGCCAAAAAGAGAGTGCATCCCGATTACGTCATCACAACCCAACACTGG Gene      : TRP2
Segment#  : 11
Offset    : 151
1st Codon : 1
     K   K   R   V   H   P   D   Y   V   I   T   T   Q   H   W   L   G   L   L   G   P   N   G   T   Q   P   Q   F   A   N
    AAGAAAAGGGTCCACCCTGACTATGTGATTACCACACAGCATTGGCTCGGCCTCCTGGGACCCAATGGCACACAGCCTCAGTTTGCCAAT Gene      : TRP2
Segment#  : 12
Offset    : 166
1st Codon : 1
     L   G   L   L   G   P   N   G   T   Q   P   Q   F   A   N   C   S   V   Y   D   F   F   V   W   L   H   Y   Y   S   V
    CTGGGACTGCTCGGCCCTAACGGAACCCAACCCCAATTCGCTAACTGTAGCGTCTACGATTTCTTTGTGTGGCTGCATTACTATAGCGTC Gene      : TRP2
Segment#  : 13
Offset    : 181
1st Codon : 1
     C   S   V   Y   D   F   F   V   W   L   H   Y   Y   S   V   R   D   T   L   L   G   P   G   R   P   Y   R   A   I   D
    TGCTCCGTGTATGACTTTTTTCGTCTGGCTCCACTATTACTCCGTGAGAGACACACTGCTCGGCCCTGGCAGACCCTATAGGGCTATCGAT Gene      : TRP2
Segment#  : 14
Offset    : 196
1st Codon : 1
     R   D   T   L   L   G   P   G   R   P   Y   R   A   I   D   F   S   H   Q   G   P   A   F   V   T   W   H   R   Y   H
    AGGGATACCCTCCTGGGACCCGGAAGGCCTTACAGAGCCATTGACTTTAGCCATCAGGGACCCGCTTTCGTCACCTGGCACAGATACCAT Gene      : TRP2
Segment#  : 15
Offset    : 211
1st Codon : 1
     F   S   H   Q   G   P   A   F   V   T   W   H   R   Y   H   L   L   C   L   E   R   D   L   Q   R   L   I   G   N   E
    TTCTCCCACCAAGGCCCTGCCTTTGTGACATGGCATAGGTATCACCTCCTGTGTCTGGAAAGGGATCTGCAAAGGCTCATCGGAAACGAA Gene      : TRP2
Segment#  : 16
Offset    : 226
1st Codon : 1
     L   L   C   L   E   R   D   L   Q   R   L   I   G   N   E   S   F   A   L   P   Y   W   N   F   A   T   G   R   N   E
    CTGCTCTGCCTCGAGAGAGACCTCCAGAGACTGATTGGCAATGAGTCCTTCGCTCTGCCTTACTGGAACTTTGCCACAGGCAGAAACGAA Gene      : TRP2
Segment#  : 17
Offset    : 241
1st Codon : 1
     S   F   A   L   P   Y   W   N   F   A   T   G   R   N   E   C   D   V   C   T   D   Q   L   F   G   A   A   R   P   D
    AGCTTTGCCCTCCCCTATTGGAATTTCGCTACCGGAAGGAATGAGTGTGACGTCTGCACAGACCAACTGTTTGGCGCTGCCAGACCCGAT Gene      : TRP2
Segment#  : 18
Offset    : 256
1st Codon : 1
     C   D   V   C   T   D   Q   L   F   G   A   A   R   P   D   D   P   T   L   I   S   R   N   S   R   F   S   S   W   E
```

Figure 27 (Cont)

TGCGATGTGTGTACCGATCAGCTCTTCGGAGCCGCTAGGCCTGACGATCCCACACTGATTAGCAGAAACTCCAGGTTTAGCTCCTGGGAA

```
Gene      : TRP2
Segment#  : 19
Offset    : 271
1st Codon : 1
  D  P  T  L  I  S  R  N  S  R  F  S  S  W  E  T  V  C  D  S  L  D  D  Y  N  H  L  V  T  L
GACCCTACCCTCATCTCCAGGAATAGCAGATTCTCCAGCTGGGAGACAGTGTGTGACTCCCTGGATGACTATAACCATCTGGTCACCCTC
```

```
Gene      : TRP2
Segment#  : 20
Offset    : 286
1st Codon : 1
  T  V  C  D  S  L  D  D  Y  N  H  L  V  T  L  C  N  G  T  Y  E  G  L  L  R  R  N  Q  M  G
ACCGTCTGCGATAGCCTCGACGATTACAATCACCTCGTGACACTGTGTAACGGAACCTATGAGGGACTGCTCAGGAGAAACCAAATGGGA
```

```
Gene      : TRP2
Segment#  : 21
Offset    : 301
1st Codon : 1
  C  N  G  T  Y  E  G  L  L  R  R  N  Q  M  G  R  N  S  M  K  L  P  T  L  K  D  I  R  D  C
TGCAATGGCACATACGAAGGCCTCCTGAGAAGGAATCAGATGGGCAGAAACTCCATGAAACTGCCTACCCTCAAGGATATCAGAGACTGT
```

```
Gene      : TRP2
Segment#  : 22
Offset    : 316
1st Codon : 1
  R  N  S  M  K  L  P  T  L  K  D  I  R  D  C  L  S  L  Q  K  F  D  N  P  P  F  F  Q  N  S
AGGAATAGCATGAAGCTCCCCACACTGAAAGACATTAGGGATTGCCTCAGCCTCCAGAAATTCGATAACCCTCCCTTTTTCCAAAACTCC
```

```
Gene      : TRP2
Segment#  : 23
Offset    : 331
1st Codon : 1
  L  S  L  Q  K  F  D  N  P  P  F  F  Q  N  S  T  F  S  F  R  N  A  L  E  G  F  D  K  A  D
CTGTCCCTGCAAAAGTTTGACAATCCCCCTTTCTTTCAGAATAGCACATTCTCCTTCAGAAACGCTCTGGAAGGCTTTGACAAAGCCGAT
```

```
Gene      : TRP2
Segment#  : 24
Offset    : 346
1st Codon : 1
  T  F  S  F  R  N  A  L  E  G  F  D  K  A  D  G  T  L  D  S  Q  V  M  S  L  H  N  L  V  H
ACCTTTAGCTTTAGGAATGCCCTCGAGGGATTCGATAAGGCTGACGGAACCCTCGACTCCCAGGTCATGTCCCTGCATAACCTCGTGCAT
```

```
Gene      : TRP2
Segment#  : 25
Offset    : 361
1st Codon : 1
  G  T  L  D  S  Q  V  M  S  L  H  N  L  V  H  S  F  L  N  G  T  N  A  L  P  H  S  A  A  N
GGCACACTGGATAGCCAAGTGATGAGCCTCCACAATCTGGTCCACTCCTTCCTCAACGGAACCAATGCCCTCCCCCATAGCGCTGCCAAT
```

```
Gene      : TRP2
Segment#  : 26
Offset    : 376
1st Codon : 1
  S  F  L  N  G  T  N  A  L  P  H  S  A  A  N  D  P  I  F  V  V  L  H  S  F  T  D  A  I  F
AGCTTTCTGAATGGCACAAACGCTCTGCCTCACTCCGCCGCTAACGATCCCATTTTCGTCGTGCTCCACTCCTTCACAGACGCTATCTTT
```

```
Gene      : TRP2
Segment#  : 27
Offset    : 391
1st Codon : 1
  D  P  I  F  V  V  L  H  S  F  T  D  A  I  F  D  E  W  M  K  R  F  N  P  P  A  D  A  W  P
GACCCTATCTTTGTGGTCCTGCATAGCTTTACCGATGCCATTTTCGATGAGTGGATGAAAAGGTTTAACCCTCCCGCTGACGCTTGGCCT
```

```
Gene      : TRP2
Segment#  : 28
Offset    : 406
1st Codon : 1
  D  E  W  M  K  R  F  N  P  P  A  D  A  W  P  Q  E  L  A  P  I  G  H  N  R  M  Y  N  M  V
GACGAATGGATGAAGAGATTCAATCCCCCTGCCGATGCCTGGCCCCAAGAGCTCGCCCCTATCGGACACAATAGGATGTACAATATGGTC
```

Figure 27 (Cont)

```
Gene       : TRP2
Segment#   : 29
Offset     : 421
1st Codon  : 1
  Q  E  L  A  P  I  G  H  N  R  M  Y  N  M  V  P  F  P  P  V  T  N  E  E  L  F  L  T  S
CAGGAACTGGCTCCCATTGGCCATAACAGAATGTATAACATGGTGCCTTTCTTTCCCCCTGTGACAAACGAAGAGCTCTTCCTCACCTCC Gene       : TRP2
Segment#   : 30
Offset     : 436
1st Codon  : 1
  P  F  P  P  V  T  N  E  E  L  F  L  T  S  D  Q  L  G  Y  S  Y  A  I  D  L  P  V  S  V
CCCTTTTTCCCTCCCGTCACCAATGAGGAACTGTTTCTGACAAGCGATCAGCTCGGCTATAGCTATGCCATTGACCTCCCCGTCAGCGTC Gene       : TRP2
Segment#   : 31
Offset     : 451
1st Codon  : 1
  D  Q  L  G  Y  S  Y  A  I  D  L  P  V  S  V  E  E  T  P  G  W  P  T  T  L  L  V  V  M  G
GACCAACTGGGATACTCCTACGCTATCGATCTGCCTGTGTCCGTGGAAGAGACACCCGGATGGCCTACCACACTGCTCGTGGTCATGGGA Gene       : TRP2
Segment#   : 32
Offset     : 466
1st Codon  : 1
  E  E  T  P  G  W  P  T  T  L  L  V  V  M  G  T  L  V  A  L  V  G  L  F  V  L  L  A  F  L
GAGGAAACCCCTGGCTGGCCCACAACCCTCCTGGTCGTGATGGGCACACTGGTCGCCCTCGTGGGACTGTTTGTGCTCCTGGCTTTCCTC Gene       : TRP2
Segment#   : 33
Offset     : 481
1st Codon  : 1
  T  L  V  A  L  V  G  L  F  V  L  L  A  F  L  Q  Y  R  R  L  R  K  G  Y  T  P  L  M  E  T
ACCCTCGTGGCTCTGGTCGGCCTCTTCGTCCTGCTCGCCTTTCTGCAATACAGAAGGCTCAGGAAAGGCTATACCCCTCTGATGGAGACA Gene       : TRP2
Segment#   : 34
Offset     : 496
1st Codon  : 1
  Q  Y  R  R  L  R  K  G  Y  T  P  L  M  E  T  H  L  S  S  K  R  Y  T  E  E  A  A  A
CAGTATAGGAGACTGAGAAAGGGATACACACCCCTCATGGAAACCCATCTGTCCAGCAAAAGGTATACCGAAGAGGCTGCCGCT Gene       : MC1R
Segment#   : 1
Offset     : 1
1st Codon  : 1
  A  A  M  A  V  Q  G  S  Q  R  R  L  L  G  S  L  N  S  T  P  T  A  I  P  Q  L  G  L  A  A
GCCGCTATGGCTGTGCAAGGCTCCCAGAGAAGGCTCCTGGGAAGCCTCAACTCCACCCCTACCGCTATCCCTCAGCTCGGCCTCGCCGCT Gene       : MC1R
Segment#   : 2
Offset     : 16
1st Codon  : 1
  L  N  S  T  P  T  A  I  P  Q  L  G  L  A  A  N  Q  T  G  A  R  C  L  E  V  S  I  S  D  G
CTGAATAGCACACCCACAGCCATTCCCCAACTGGGACTGGCTGCCAATCAGACAGGCGCTAGGTGTCTGGAAGTGTCCATCTCCGACGGA Gene       : MC1R
Segment#   : 3
Offset     : 31
1st Codon  : 1
  N  Q  T  G  A  R  C  L  E  V  S  I  S  D  G  L  F  L  S  L  G  L  V  S  L  V  E  N  A  L
AACCAAACCGGAGCCAGATGCCTCGAGGTCAGCATTAGCGATGGCCTCTTCCTCAGCCTCGGCCTCGTGTCCCTGGTCGAGAATGCCCTC Gene       : MC1R
Segment#   : 4
Offset     : 46
1st Codon  : 1
  L  F  L  S  L  G  L  V  S  L  V  E  N  A  L  V  V  A  T  I  A  K  N  R  N  L  H  S  P  M
CTGTTTCTGTCCCTGGGACTGGTCAGCCTCGTGGAAAACGCTCTGGTCGTGGCTACCATTGCCAAAAACAGAAACCTCCACTCCCCCATG Gene       : MC1R
Segment#   : 5
```

Figure 27 (Cont)

```
Offset     : 61
1st Codon  : 1
    V  V  A  T  I  A  K  N  R  N  L  H  S  P  M  Y  C  F  I  C  C  L  A  L  S  D  L  L  V  S
GTGGTCGCCACAATCGCTAAGAATAGGAATCTGCATAGCCCTATGTATTGCTTTATCTGTTGCCTCGCCCTCAGCGATCTGCTCGTGTCC Gene       : MC1R
Segment#   : 6
Offset     : 76
1st Codon  : 1
    Y  C  F  I  C  C  L  A  L  S  D  L  L  V  S  G  T  N  V  L  E  T  A  V  I  L  L  L  E  A
TACTGTTTCATTTGCTGTCTGGCTCTGTCCGACCTCCTGGTCAGCGGAACCAATGTGCTCGAGACAGCCGTCATCCTCCTGCTCGAGGCT Gene       : MC1R
Segment#   : 7
Offset     : 91
1st Codon  : 1
    G  T  N  V  L  E  T  A  V  I  L  L  L  E  A  G  A  L  V  A  R  A  A  V  L  Q  Q  L  D  N
GGCACAAACGTCCTGGAAACCGCTGTGATTCTGCTCCTGGAAGCCGGAGCCCTCGTGGCTAGGGCTGCCGTCCTGCAACAGCTCGACAAT Gene       : MC1R
Segment#   : 8
Offset     : 106
1st Codon  : 1
    G  A  L  V  A  R  A  A  V  L  Q  Q  L  D  N  V  I  D  V  I  T  C  S  S  M  L  S  S  L  C
GGCGCTCTGGTCGCCAGAGCCGCTGTGCTCCAGCAACTGGATAACGTCATCGATGTGATTACCTGTAGCTCCATGCTCAGCTCCCTGTGT Gene       : MC1R
Segment#   : 9
Offset     : 121
1st Codon  : 1
    V  I  D  V  I  T  C  S  S  M  L  S  S  L  C  F  L  G  A  I  A  V  D  R  Y  I  S  I  F  Y
GTGATTGACGTCATCACATGCTCCAGCATGCTGTCCAGCCTCTGCTTTCTGGGAGCCATTGCCGTCGACAGATACATTAGCATTTTCTAT Gene       : MC1R
Segment#   : 10
Offset     : 136
1st Codon  : 1
    F  L  G  A  I  A  V  D  R  Y  I  S  I  F  Y  A  L  R  Y  H  S  I  V  T  L  P  R  A  P  R
TTCCTCGGCGCTATCGCTGTGGATAGGTATATCTCCATCTTTTACGCTCTGAGATACCATAGCATTGTGACACTGCCTAGGGCTCCCAGA Gene       : MC1R
Segment#   : 11
Offset     : 151
1st Codon  : 1
    A  L  R  Y  H  S  I  V  T  L  P  R  A  P  R  A  V  A  A  I  W  V  A  S  V  V  F  S  T  L
GCCCTCAGGTATCACTCCATCGTCACCCTCCCCAGAGCCCCTAGGGCTGTGGCTGCCATTTGGGTCGCCTCCGTGGTCTTCTCCACCCTC Gene       : MC1R
Segment#   : 12
Offset     : 166
1st Codon  : 1
    A  V  A  A  I  W  V  A  S  V  V  F  S  T  L  F  I  A  Y  Y  D  H  V  A  V  L  L  C  L  V
GCCGTCGCCGCTATCTGGGTGGCTAGCGTCGTGTTTAGCACACTGTTTATCGCTTACTATGACCATGTGGCTGTGCTCCTGTGTCTGGTC Gene       : MC1R
Segment#   : 13
Offset     : 181
1st Codon  : 1
    F  I  A  Y  Y  D  H  V  A  V  L  L  C  L  V  V  F  F  L  A  M  L  V  L  M  A  V  L  Y  V
TTCATTGCCTATTACGATCACGTCGCCGTCCTGCTCTGCCTCGTGGTCTTCTTTCTGGCTATGCTCGTGCTCATGGCTGTGCTCTACGTC Gene       : MC1R
Segment#   : 14
Offset     : 196
1st Codon  : 1
    V  F  F  L  A  M  L  V  L  M  A  V  L  Y  V  H  M  L  A  R  A  C  Q  H  A  Q  G  I  A  R
GTGTTTTTCCTCGCCATGCTGGTCCTGATGGCCGTCCTGTATGTGCATATGCTCGCCAGAGCCTGTCAGCATGCCCAAGGCATTGCCAGA Gene       : MC1R
Segment#   : 15
Offset     : 211
1st Codon  : 1
```

Figure 27 (Cont)

```
         H  M  L  A  R  A  C  Q  H  A  Q  G  I  A  R  L  H  K  R  Q  R  P  V  H  Q  G  F  G  L  K
         CACATGCTGGCTAGGGCTTGCCAACACGCTCAGGGAATCGCTAGGCTCCACAAAAGGCAAAGGCCTGTGCATCAGGGATTCGGACTGAAA

Gene       : MC1R
Segment#   : 16
Offset     : 226
1st Codon  : 1
         L  H  K  R  Q  R  P  V  H  Q  G  F  G  L  K  G  A  V  T  L  T  I  L  L  G  I  F  F  L  C
         CTGCATAAGAGACAGAGACCCGTCCACCAAGGCTTTGGCCTCAAGGGAGCCGTCACCCTCACCATTCTGCTCGGCATTTTCTTTCTGTGT Gene       : MC1R
Segment#   : 17
Offset     : 241
1st Codon  : 1
         G  A  V  T  L  T  I  L  L  G  I  F  F  L  C  W  G  P  F  F  L  H  L  T  L  I  V  L  C  P
         GGCGCTGTGACACTGACAATCCTCCTGGGAATCTTTTTCCTCTGCTGGGGCCCTTTCTTTCTGCATCTGACACTGATTGTGCTCTGCCCT Gene       : MC1R
Segment#   : 18
Offset     : 256
1st Codon  : 1
         W  G  P  F  F  L  H  L  T  L  I  V  L  C  P  E  H  P  T  C  G  C  I  F  K  N  F  N  L  F
         TGGGGACCCTTTTTCCTCCACCTCACCCTCATCGTCCTGTGTCCCGAACACCCTACCTGTGGCTGTATCTTTAAGAATTTCAATCTGTTT Gene       : MC1R
Segment#   : 19
Offset     : 271
1st Codon  : 1
         E  H  P  T  C  G  C  I  F  K  N  F  N  L  F  L  A  L  I  I  C  N  A  I  I  D  P  L  I  Y
         GAGCATCCCACATGCGGATGCATTTTCAAAAACTTTAACCTCTTCCTCGCCCTCATCATTTGCAATGCCATTATCGATCCCCTCATCTAT Gene       : MC1R
Segment#   : 20
Offset     : 286
1st Codon  : 1
         L  A  L  I  I  C  N  A  I  I  D  P  L  I  Y  A  F  H  S  Q  E  L  R  R  T  L  K  E  V  L
         CTGGCTCTGATTATCTGTAACGCTATCATTGACCCTCTGATTTACGCTTTCCATAGCCAAGAGCTCAGGAGAACCCTCAAGGAAGTGCTC Gene       : MC1R
Segment#   : 21
Offset     : 301
1st Codon  : 1
         A  F  H  S  Q  E  L  R  R  T  L  K  E  V  L  T  C  S  W  A  A
         GCCTTTCACTCCCAGGAACTGAGAAGGACACTGAAAGAGGTCCTGACATGCTCCTGGGCTGCC Gene       : MUC1F
Segment#   : 1
Offset     : 1
1st Codon  : 1
         A  A  M  T  P  G  T  Q  S  P  F  F  L  L  L  L  L  T  V  L  T  V  V  T  G  S  G  H  A  S
         GCCGCTATGACACCCGGAACCCAAAGCCCTTTCTTTCTGCTCCTGCTCCTGACAGTGCTCACCGTCGTGACAGGCTCCGGCCATGCCTCC Gene       : MUC1F
Segment#   : 2
Offset     : 16
1st Codon  : 1
         L  L  T  V  L  T  V  V  T  G  S  G  H  A  S  S  T  P  G  G  E  K  E  T  S  A  T  Q  R  S
         CTGCTCACCGTCCTGACAGTGGTCACCGGAAGCGGACACGCTAGCTCCACCCCTGGCGGAGAGAAAGAGACAAGCGCTACCCAAAGGTCC Gene       : MUC1F
Segment#   : 3
Offset     : 31
1st Codon  : 1
         S  T  P  G  G  E  K  E  T  S  A  T  Q  R  S  S  V  P  S  S  T  E  K  N  A  V  S  M  T  S
         AGCACACCCGGAGGCGAAAAGGAAACCTCCGCCACACAGAGAAGCTCCGTGCCTAGCTCCACCGAAAAGAATGCCGTCAGCATGACCTCC Gene       : MUC1F
Segment#   : 4
Offset     : 46
1st Codon  : 1
         S  V  P  S  S  T  E  K  N  A  V  S  M  T  S  S  V  L  S  S  H  S  P  G  S  G  S  S  T  T
         AGCGTCCCCTCCAGCACAGAGAAAAACGCTGTGTCCATGACAAGCTCCGTGCTCAGCTCCCACTCCCCCGGAAGCGGAAGCTCCACCACA
```

Figure 27 (Cont)

```
Gene       : MUC1F
Segment#   : 5
Offset     : 61
1st Codon  : 1
  S   V   L   S   S   H   S   P   G   S   G   S   S   T   T   Q   G   Q   D   V   T   L   A   P   A   T   E   P   A   S
AGCGTCCTGTCCAGCCATAGCCCTGGCTCCGGCTCCAGCACAACCCAAGGCCAAGACGTCACCCTCGCCCCTGCCACAGAGCCTGCCTCC Gene       : MUC1F
Segment#   : 6
Offset     : 76
1st Codon  : 1
  Q   G   Q   D   V   T   L   A   P   A   T   E   P   A   S   G   S   A   A   T   W   G   Q   D   V   T   S   V   P   V
CAGGGACAGGATGTGACACTGGCTCCCGCTACCGAACCCGCTAGCGGAAGCGCTGCCACATGGGGACAGGATGTGACAAGCGTCCCCGTC Gene       : MUC1F
Segment#   : 7
Offset     : 91
1st Codon  : 1
  G   S   A   A   T   W   G   Q   D   V   T   S   V   P   V   T   R   P   A   L   G   S   T   T   P   P   A   H   D   V
GGCTCCGCCGCTACCTGGGGCCAAGACGTCACCTCCGTGCCTGTGACAAGGCCTGCCCTCGGCTCCACCACACCCCCTGCCCATGACGTC Gene       : MUC1F
Segment#   : 8
Offset     : 106
1st Codon  : 1
  T   R   P   A   L   G   S   T   T   P   P   A   H   D   V   T   S   A   P   D   N   K   A   A
ACCAGACCCGCTCTGGGAAGCACAACCCCTCCCGCTCACGATGTGACAAGCGCTCCCGATAACAAAGCCGCT Gene       : MUC1R
Segment#   : 1
Offset     : 1
1st Codon  : 1
  A   A   N   R   P   A   L   G   S   T   A   P   P   V   H   N   V   T   S   A   S   G   S   A   S   G   S   A   S   T
GCCGCTAACAGACCCGCTCTGGGAAGCACAGCCCCTCCCGTCCACAATGTGACAAGCGCTAGCGGAAGCGCTAGCGGAAGCGCTAGCACA Gene       : MUC1R
Segment#   : 2
Offset     : 16
1st Codon  : 1
  N   V   T   S   A   S   G   S   A   S   G   S   A   S   T   L   V   H   N   G   T   S   A   R   A   T   T   T   P   A
AACGTCACCTCCGCCTCCGGCTCCGCCTCCGGCTCCGCCTCCACCCTCGTGCATAACGGAACCTCCGCCAGAGCCACAACCACACCCGCT Gene       : MUC1R
Segment#   : 3
Offset     : 31
1st Codon  : 1
  L   V   H   N   G   T   S   A   R   A   T   T   T   P   A   S   K   S   T   P   F   S   I   P   S   H   H   S   D   T
CTGGTCCACAATGGCACAAGCGCTAGGGCTACCACAACCCCTGCCTCCAAGTCCACCCCTTTCTCCATCCCTAGCCATCACTCCGACACA Gene       : MUC1R
Segment#   : 4
Offset     : 46
1st Codon  : 1
  S   K   S   T   P   F   S   I   P   S   H   H   S   D   T   P   T   T   L   A   S   H   S   T   K   T   D   A   S   S
AGCAAAAGCACACCCTTTAGCATTCCCTCCCACCATAGCGATACCCCTACCACACTGGCTAGCCATAGCACAAAGACAGACGCTAGCTCC Gene       : MUC1R
Segment#   : 5
Offset     : 61
1st Codon  : 1
  P   T   T   L   A   S   H   S   T   K   T   D   A   S   S   T   H   H   S   S   V   P   P   L   T   S   S   N   H   S
CCCACAACCCTCGCCTCCCACTCCACCAAAACCGATGCCTCCAGCACACACCATAGCTCCGTGCCTCCCCTCACCTCCAGCAATCACTCC Gene       : MUC1R
Segment#   : 6
Offset     : 76
1st Codon  : 1
  T   H   H   S   S   V   P   P   L   T   S   S   N   H   S   T   S   P   Q   L   S   T   G   V   S   F   F   F   L   S
ACCCATCACTCCAGCGTCCCCCCTCTGACAAGCTCCAACCATAGCACAAGCCCTCAGCTCAGCACAGGCGTCAGCTTTTTCTTTCTGTCC Gene       : MUC1R
```

Figure 27 (Cont)

```
Segment#  : 7
Offset    : 91
1st Codon : 1
 T  S  P  Q  L  S  T  G  V  S  F  F  F  L  S  F  H  I  S  N  L  Q  F  N  S  S  L  E  D  P
ACCTCCCCCAACTGTCCACCGGAGTGTCCTTCTTTTTCCTCAGCTTTCACATTAGCAATCTGCAATTCAATAGCTCCCTGGAAGACCCT Gene      : MUC1R
Segment#  : 8
Offset    : 106
1st Codon : 1
 F  H  I  S  N  L  Q  F  N  S  S  L  E  D  P  S  T  D  Y  Y  Q  E  L  Q  R  D  I  S  E  M
TTCCATATCTCCAACCTCCAGTTTAACTCCAGCCTCGAGGATCCCTCCACCGATTACTATCAGGAACTGCAAAGGGATATCTCCGAGATG Gene      : MUC1R
Segment#  : 9
Offset    : 121
1st Codon : 1
 S  T  D  Y  Y  Q  E  L  Q  R  D  I  S  E  M  F  L  Q  I  Y  K  Q  G  G  F  L  G  L  S  N
AGCACAGACTATTACCAAGAGCTCCAGAGAGACATTAGCGAAATGTTTCTGCAAATCTATAAGCAAGGCGGATTCCTCGGCCTCAGCAAT Gene      : MUC1R
Segment#  : 10
Offset    : 136
1st Codon : 1
 F  L  Q  I  Y  K  Q  G  G  F  L  G  L  S  N  I  K  F  R  P  G  S  V  V  V  Q  L  T  L  A
TTCCTCCAGATTTACAAACAGGGAGGCTTTCTGGGACTGTCCAACATTAAGTTTAGGCCTGGCTCCGTGGTCGTGCAACTGACACTGGCT Gene      : MUC1R
Segment#  : 11
Offset    : 151
1st Codon : 1
 I  K  F  R  P  G  S  V  V  V  Q  L  T  L  A  F  R  E  G  T  I  N  V  H  D  V  E  T  Q  F
ATCAAATTCAGACCCGGAAGCGTCGTGGTCCAGCTCACCCTCGCCTTTAGGGAAGGCACAATCAATGTGCATGACGTCGAGACACAGTTT Gene      : MUC1R
Segment#  : 12
Offset    : 166
1st Codon : 1
 F  R  E  G  T  I  N  V  H  D  V  E  T  Q  F  N  Q  Y  K  T  E  A  A  S  R  Y  N  L  T  I
TTCAGAGAGGGAACCATTAACGTCCACGATGTGGAAACCCAATTCAATCAGTATAAGACAGAGGCTGCCTCCAGGTATAACCTCACCATT Gene      : MUC1R
Segment#  : 13
Offset    : 181
1st Codon : 1
 N  Q  Y  K  T  E  A  A  S  R  Y  N  L  T  I  S  D  V  S  V  S  D  V  P  F  P  F  S  A  Q
AACCAATACAAAACCGAAGCCGCTAGCAGATACAATCTGACAATCTCCGACGTCAGCGTCAGCGATGTGCCTTTCCCTTTCTCCGCCCAA Gene      : MUC1R
Segment#  : 14
Offset    : 196
1st Codon : 1
 S  D  V  S  V  S  D  V  P  F  P  F  S  A  Q  S  G  A  G  V  P  G  W  G  I  A  L  L  V  L
AGCGATGTGTCCGTGTCCGACGTCCCCTTTCCCTTTAGCGCTCAGTCCGGCGCTGGCGTCCCCGGATGGGGAATCGCTCTGCTCGTGCTC Gene      : MUC1R
Segment#  : 15
Offset    : 211
1st Codon : 1
 S  G  A  G  V  P  G  W  G  I  A  L  L  V  L  V  C  V  L  V  A  L  A  I  V  Y  L  I  A  L
AGCGGAGCCGGAGTGCCTGGCTGGGGCATTGCCCTCCTGGTCCTGGTCTGCGTCCTGGTCGCCCTCGCCATTGTGTATCTGATTGCCCTC Gene      : MUC1R
Segment#  : 16
Offset    : 226
1st Codon : 1
 V  C  V  L  V  A  L  A  I  V  Y  L  I  A  L  A  V  C  Q  C  R  R  K  N  Y  G  Q  L  D  I
GTGTGTGTGCTCGTGGCTCTGGCTATCGTCTACCTCATCGCTCTGGCTGTGTGTCAGTGTAGGAGAAAGAATTACGGACAGCTCGACATT Gene      : MUC1R
Segment#  : 17
Offset    : 241
```

```
1st Codon : 1
 A  V  C  Q  C  R  R  K  N  Y  G  Q  L  D  I  F  P  A  R  D  T  Y  H  P  M  S  E  Y  P  T
GCCGTCTGCCAATGCAGAAGGAAAAACTATGGCCAACTGGATATCTTTCCCGCTAGGGATACCTATCACCCTATGTCCGAGTATCCCACA Gene      : MUC1R
Segment#  : 18
Offset    : 256
1st Codon : 1
 F  P  A  R  D  T  Y  H  P  M  S  E  Y  P  T  Y  H  T  H  G  R  Y  V  P  P  S  S  T  D  R
TTCCCTGCCAGAGACACATACCATCCCATGAGCGAATACCCTACCTATCACACACACGGAAGGTATGTGCCTCCCTCCAGCACAGACAGA Gene      : MUC1R
Segment#  : 19
Offset    : 271
1st Codon : 1
 Y  H  T  H  G  R  Y  V  P  P  S  S  T  D  R  S  P  Y  E  K  V  S  A  G  N  G  G  S  S  L
TACCATACCCATGGCAGATACGTCCCCCCTAGCTCCACCGATAGGTCCCCCTATGAGAAAGTGTCCGCCGGAAACGGAGGCTCCAGCCTC Gene      : MUC1R
Segment#  : 20
Offset    : 286
1st Codon : 1
 S  P  Y  E  K  V  S  A  G  N  G  G  S  S  L  S  Y  T  N  P  A  V  A  A  A  S  A  N  L  A
AGCCCTTACGAAAAGGTCAGCGCTGGCAATGGCGGAAGCTCCCTGTCCTACACAAACCCTGCCGTCGCCGCTGCCTCCGCCAATCTGGCT Gene      : MUC1R
Segment#  : 21
Offset    : 301
1st Codon : 1
 S  Y  T  N  P  A  V  A  A  A  S  A  N  L  A  A
AGCTATACCAATCCCGCTGTGGCTGCCGCTAGCGCTAACCTCGCCGCT Segments in scrambled order:
-----------------------------
gp100 #4
 W  N  R  Q  L  Y  P  E  W  T  E  A  Q  R  L  D  C  W  R  G  G  Q  V  S  L  K  V  S  N  D
TGGAATAGGCAACTGTATCCCGAATGGACAGAGGCTCAGAGACTGGATTGCTGGAGGGGAGGCCAAGTGTCCCTGAAAGTGTCCAACGAT TRP2 #6
 P  Y  I  L  R  N  Q  D  D  R  E  L  W  P  R  K  F  F  H  R  T  C  K  C  T  G  N  F  A  G
CCCTATATCCTCAGGAATCAGGATGACAGAGAGCTCTGGCCTAGGAAATTCTTTCACAGAACCTGTAAGTGTACCGGAAACTTTGCCGGA Tyros #30
 R  N  G  D  F  F  I  S  S  K  D  L  G  Y  D  Y  S  Y  L  Q  D  S  D  P  D  S  F  Q  D  Y
AGGAATGGCGATTTCTTTATCTCCAGCAAAGACCTCGGCTATGACTATAGCTATCTGCAAGACTCCGACCCTGACTCCTTCCAAGACTAT TRP-1 #1
 A  A  P  A  F  L  T  W  H  R  Y  H  L  L  R  L  E  K  D  M  Q  E  M  L  Q  E  P  S  F  S
GCCGCTCCCGCTTTTCCTCACCTGGCACAGATACCATCTGCTCAGGCTCGAGAAAGACATGCAGGAAATGCTCCAGGAACCCTCCTTCTCC Tyros #29
 G  H  N  R  E  S  Y  M  V  P  F  I  P  L  Y  R  N  G  D  F  F  I  S  S  K  D  L  G  Y  D
GGCCATAACAGAGAGTCCTACATGGTGCCTTTCATTCCCCTCTACAGAAACGGAGACTTTTTCATTAGCTCCAAGGATCTGGGATACGAT TRP2 #16
 L  L  C  L  E  R  D  L  Q  R  L  I  G  N  E  S  F  A  L  P  Y  W  N  F  A  T  G  R  N  E
CTGCTCTGCCTCGAGAGAGACCTCCAGAGACTGATTGGCAATGAGTCCTTCGCTCTGCCTTACTGGAACTTTGCCACAGGCAGAAACGAA gp100 #23
 T  T  E  V  V  G  T  T  P  G  Q  A  P  T  A  E  P  S  G  T  T  S  V  Q  V  P  T  T  E  V
ACCACAGAGGTCGTGGGAACCACACCCGGACAGGCTCCCACAGCCGAACCCTCCGGCACAACCTCCGTGCAAGTGCCTACCACAGAGGTC MUC1R #9
 S  T  D  Y  Y  Q  E  L  Q  R  D  I  S  E  M  F  L  Q  I  Y  K  Q  G  G  F  L  G  L  S  N
AGCACAGACTATTACCAAGAGCTCCAGAGAGACATTAGCGAAATGTTTCTGCAAATCTATAAGCAAGGCGGATTCCTCGGCCTCAGCAAT gp100 #36
 A  C  M  E  I  S  S  P  G  C  Q  P  P  A  Q  R  L  C  Q  P  V  L  P  S  P  A  C  Q  L  V
GCCTGTATGGAAATCTCCAGCCCTGGCTGTCAGCCTCCCGCTCAGAGACTGTGTCAGCCTGTGCTCCCCTCCCCCGCTTGCCAACTGGTC TRP2 #31
 D  Q  L  G  Y  S  Y  A  I  D  L  P  V  S  V  E  E  T  P  G  W  P  T  T  L  L  V  V  M  G
```

Figure 27 (Cont)

```
GACCAACTGGGATACTCCTACGCTATCGATCTGCCTGTGTCCGTGGAAGAGACACCCGGATGGCCTACCACACTGCTCGTGGTCATGGGA
```

TRP-1 #7
```
  T  E  D  G  P  I  R  R  N  P  A  G  N  V  A  R  P  M  V  Q  R  L  P  E  P  Q  D  V  A  Q
ACCGAAGACGGACCCATTAGGAGAAACCCTGCCGGAAACGTCGCCAGACCCATGGTGCAAAGGCTCCCCGAACCCCAAGACGTCGCCCAA
```

TRP2 #3
```
  C  M  T  V  D  S  L  V  N  K  E  C  C  P  R  L  G  A  E  S  A  N  V  C  G  S  Q  Q  G  R
TGCATGACCGTCGACTCCCTGGTCAACAAAGAGTGTTGCCCTAGGCTCGGCGCTGAGTCCGCCAATGTGTGTGGCTCCCAGCAAGGCAGA
```

MUC1R #13
```
  N  Q  Y  K  T  E  A  A  S  R  Y  N  L  T  I  S  D  V  S  V  S  D  V  P  F  P  F  S  A  Q
AACCAATACAAAACCGAAGCCGCTAGCAGATACAATCTGACAATCTCCGACGTCAGCGTCAGCGATGTGCCTTTCCCTTTCTCCGCCCAA
```

TRP2 #1
```
  A  A  M  S  P  L  W  W  G  F  L  L  S  C  L  G  C  K  I  L  P  G  A  Q  G  Q  F  P  R  V
GCCGCTATGTCCCCCCTCTGGTGGGGCTTTCTGCTCAGCTGTCTGGGATGCAAAATCCTCCCCGGAGCCCAAGGCCAATTCCCTAGGGTC
``` gp100 #18
```
  A  D  L  S  Y  T  W  D  F  G  D  S  S  G  T  L  I  S  R  A  L  V  V  T  H  T  Y  L  E  P
GCCGATCTGTCCTACACATGGGATTTCGGAGACTCCAGCGGAACCCTCATCTCCAGGGCTCTGGTCGTGACACACACATACCTCGAGCCT
``` gp100 #27
```
  L  A  E  M  S  T  P  E  A  T  G  M  T  P  A  E  V  S  I  V  V  L  S  G  T  T  A  A  Q  V
CTGGCTGAGATGAGCACACCCGAAGCCACAGGCATGACCCCTGCCGAAGTGTCCATCGTCGTGCTCAGCGGAACCACAGCCGCTCAGGTC
```

MUC1R #11
```
  I  K  F  R  P  G  S  V  V  V  Q  L  T  L  A  F  R  E  G  T  I  N  V  H  D  V  E  T  Q  F
ATCAAATTCAGACCCGGAAGCGTCGTGGTCCAGCTCACCCTCGCCTTTAGGGAAGGCACAATCAATGTGCATGACGTCGAGACACAGTTT
```

MUC1F #7
```
  G  S  A  A  T  W  G  Q  D  V  T  S  V  P  V  T  R  P  A  L  G  S  T  T  P  P  A  H  D  V
GGCTCCGCCGCTACCTGGGGCCAAGACGTCACCTCCGTGCCTGTGACAAGGCCTGCCCTCGGCTCCACCACACCCCCTGCCCATGACGTC
```

MC1R #16
```
  L  H  K  R  Q  R  P  V  H  Q  G  F  G  L  K  G  A  V  T  L  T  I  L  L  G  I  F  F  L  C
CTGCATAAGAGACAGAGACCCGTCCACCAAGGCTTTGGCCTCAAGGGAGCCGTCACCCTCACCATTCTGCTCGGCATTTTCTTTCTGTGT
```

MC1R #20
```
  L  A  L  I  I  C  N  A  I  I  D  P  L  I  Y  A  F  H  S  Q  E  L  R  R  T  L  K  E  V  L
CTGGCTCTGATTATCTGTAACGCTATCATTGACCCTCTGATTTACGCTTTCCATAGCCAAGAGCTCAGGAGAACCCTCAAGGAAGTGCTC
```

TRP2 #7
```
  K  F  F  H  R  T  C  K  C  T  G  N  F  A  G  Y  N  C  G  D  C  K  F  G  W  T  G  P  N  C
AAGTTTTTCCATAGGACATGCAAATGCACAGGCAATTTCGCTGGCTATAACTGTGGCGATTGCAAATTCGGATGGACAGGCCCTAACTGT
```

TRP2 #23
```
  L  S  L  Q  K  F  D  N  P  P  F  F  Q  N  S  T  F  S  F  R  N  A  L  E  G  F  D  K  A  D
CTGTCCCTGCAAAAGTTTGACAATCCCCCTTTCTTTCAGAATAGCACATTCTCCTTCAGAAACGCTCTGGAAGGCTTTGACAAAGCCGAT
```

MUC1R #4
```
  S  K  S  T  P  F  S  I  P  S  H  H  S  D  T  P  T  T  L  A  S  H  S  T  K  T  D  A  S  S
AGCAAAAGCACACCCTTTAGCATTCCCTCCCACCATAGCGATACCCCTACCACACTGGCTAGCCATAGCACAAAGACAGACGCTAGCTCC
```

MUC1R #1
```
  A  A  N  R  P  A  L  G  S  T  A  P  P  V  H  N  V  T  S  A  S  G  S  A  S  G  S  A  S  T
GCCGCTAACAGACCCGCTCTGGGAAGCACAGCCCCTCCCGTCCACAATGTGACAAGCGCTAGCGGAAGCGCTAGCGGAAGCGCTAGCACA
```

TRP2 #21
```
  C  N  G  T  Y  E  G  L  L  R  R  N  Q  M  G  R  N  S  M  K  L  P  T  L  K  D  I  R  D  C
TGCAATGGCACATACGAAGGCCTCCTGAGAAGGAATCAGATGGGCAGAAACTCCATGAAACTGCCTACCCTCAAGGATATCAGAGACTGT
```

MUC1R #6
```
  T  H  H  S  S  V  P  P  L  T  S  S  N  H  S  T  S  P  Q  L  S  T  G  V  S  F  F  F  L  S
ACCCATCACTCCAGCGTCCCCCCTCTGACAAGCTCCAACCATAGCACAAGCCCTCAGCTCAGCACAGGCGTCAGCTTTTTCTTTCTGTCC
```

MC1R #13
```
  F  I  A  Y  Y  D  H  V  A  V  L  L  C  L  V  V  F  F  L  A  M  L  V  L  M  A  V  L  Y  V
TTCATTGCCTATTACGATCACGTCGCCGTCCTGCTCTGCCTCGTGGTCTTCTTTCTGGCTATGCTCGTGCTCATGGCTGTGCTCTACGTC
```

Tyros #16
```
  K  L  T  G  D  E  N  F  T  I  P  Y  W  D  W  R  D  A  E  K  C  D  I  C  T  D  E  Y  M  G
```

Figure 27 (Cont)

```
AAGCTCACCGGAGACGAAAACTTTACCATTCCCTATTGGGATTGGAGAGACGCTGAGAAATGCGATATCTGTACCGATGAGTATATGGGA
``` gp100 #32
```
  L  R  L  V  K  R  Q  V  P  L  D  C  V  L  Y  R  Y  G  S  F  S  V  T  L  D  I  V  Q  G  I
CTGAGACTGGTCAAGAGACAGGTCCCCCTCGACTGTGTGCTCTACAGATACGGAAGCTTTAGCGTCACCCTCGACATTGTGCAAGGCATT
```

MUC1R #10
```
  F  L  Q  I  Y  K  Q  G  G  F  L  G  L  S  N  I  K  F  R  P  G  S  V  V  V  Q  L  T  L  A
TTCCTCCAGATTTACAAACAGGGAGGCTTTCTGGGACTGTCCAACATTAAGTTTAGGCCTGGCTCCGTGGTCGTGCAACTGACACTGGCT
```

MC1R #9
```
  V  I  D  V  I  T  C  S  S  M  L  S  S  L  C  F  L  G  A  I  A  V  D  R  Y  I  S  I  F  Y
GTGATTGACGTCATCACATGCTCCAGCATGCTGTCCAGCCTCTGCTTTCTGGGAGCCATTGCCGTCGACAGATACATTAGCATTTTCTAT
```

Tyros #21
```
  R  N  P  G  N  H  D  K  S  R  T  P  R  L  P  S  S  A  D  V  E  F  C  L  S  L  T  Q  Y  E
AGGAATCCCGGAAACCATGACAAAAGCAGAACCCCTAGGCTCCCCTCCAGCGCTGACGTCGAGTTTTGCCTCAGCCTCACCCAATACGAA
```

TRP-1 #14
```
  F  D  E  W  L  R  R  Y  N  A  D  I  S  T  F  P  L  E  N  A  P  I  G  H  N  R  Q  Y  N  M
TTCGATGAGTGGCTGAGAAGGTATAACGCTGACATTAGCACATTCCCTCTGGAAAACGCTCCCATTGGCCATAACAGACAGTATAACATG
``` gp100 #39
```
  V  S  L  A  D  T  N  S  L  A  V  V  S  T  Q  L  I  M  P  G  Q  E  A  G  L  G  Q  V  P  L
GTGTCCCTGGCTGACACAAACTCCCTGGCTGTGGTCAGCACACAGCTCATCATGCCCGGACAGGAAGCCGGACTGGGACAGGTCCCCCTC
``` gp100 #20
```
  G  P  V  T  A  Q  V  V  L  Q  A  A  I  P  L  T  S  C  G  S  S  P  V  P  G  T  T  D  G  H
GGCCCTGTGACAGCCCAAGTGGTCCTGCAAGCCGCTATCCCTCTGACAAGCTGTGGCTCCAGCCCTGTGCCTGGCACAACCGATGGCCAT
```

Tyros #8
```
  K  F  G  F  W  G  P  N  C  T  E  R  R  L  L  V  R  R  N  I  F  D  L  S  A  P  E  K  D  K
AAGTTTGGCTTTTGGGGACCCAATTGCACAGAGAGAAGGCTCCTGGTCAGGAGAAACATTTTCGATCTGTCCGCCCCTGAGAAAGACAAA
``` gp100 #13
```
  L  G  T  H  T  M  E  V  T  V  Y  H  R  R  G  S  R  S  Y  V  P  L  A  H  S  S  A  F  T
CTGGGAACCCATACCATGGAGGTCACCGTCTACCATAGGAGAGGCTCCAGGTCCTACGTCCCCCTCGCCCATAGCTCCAGCGCTTTCACA
```

MC1R #12
```
  A  V  A  A  I  W  V  A  S  V  V  F  S  T  L  F  I  A  Y  Y  D  H  V  A  V  L  L  C  L  V
GCCGTCGCCGCTATCTGGGTGGCTAGCGTCGTGTTTAGCACACTGTTTATCGCTTACTATGACCATGTGGCTGTGCTCCTGTGTCTGGTC
```

TRP2 #25
```
  G  T  L  D  S  Q  V  M  S  L  H  N  L  V  H  S  F  L  N  G  T  N  A  L  P  H  S  A  A  N
GGCACACTGGATAGCCAAGTGATGAGCCTCCACAATCTGGTCCACTCCTTCCTCAACGGAACCAATGCCCTCCCCCATAGCGCTGCCAAT
```

MART #4
```
  G  C  W  Y  C  R  R  R  N  G  Y  R  A  L  M  D  K  S  L  H  V  G  T  Q  C  A  L  T  R  R
GGCTGTTGGTATTGCAGAAGGAGAAACGGATACAGAGCCCTCATGGATAAGTCCCTGCATGTGGGAACCCAATGCGCTCTGACAAGGAGA
```

Tyros #15
```
  P  W  H  R  L  F  L  L  R  W  E  Q  E  I  Q  K  L  T  G  D  E  N  F  T  I  P  Y  W  D  W
CCCTGGCACAGACTGTTTCTGCTCAGGTGGGAGCAAGAGATTCAGAAACTGACAGGCGATGAGAATTTCACAATCCCTTACTGGGACTGG
```

MC1R #1
```
  A  A  M  A  V  Q  G  S  Q  R  R  L  L  G  S  L  N  S  T  P  T  A  I  P  Q  L  G  L  A  A
GCCGCTATGGCTGTGCAAGGCTCCCAGAGAAGGCTCCTGGGAAGCCTCAACTCCACCCCTACCGCTATCCCTCAGCTCGGCCTCGCCGCT
```

MC1R #5
```
  V  V  A  T  I  A  K  N  R  N  L  H  S  P  M  Y  C  F  I  C  C  L  A  L  S  D  L  L  V  S
GTGGTCGCCACAATCGCTAAGAATAGGAATCTGCATAGCCCTATGTATTGCTTTATCTGTTGCCTCGCCCTCAGCGATCTGCTCGTGTCC
```

Tyros #25
```
  Q  S  S  M  H  N  A  L  H  I  Y  M  N  G  T  M  S  Q  V  Q  G  S  A  N  D  P  I  F  L  L
CAGTCCAGCATGCACAATGCCCTCCACATTTACATGAACGGAACCATGAGCCAAGTGCAAGGCTCCGCCAATGACCCTATCTTTCTGCTC
```

Tyros #18
```
  G  Q  H  P  T  N  P  N  L  L  S  P  A  S  F  F  S  S  W  Q  I  V  C  S  R  L  E  E  Y  N
GGCCAACACCCTACCAATCCCAATCTGCTCAGCCCTGCCTCCTTCTTTAGCTCCTGGCAAATCGTCTGCTCCAGGCTCGAGGAATACAAT
```

```
TACTGTTTCATTTGCTGTCTGGCTCTGTCCGACCTCCTGGTCAGCGGAACCAATGTGCTCGAGACAGCCGTCATCCTCCTGCTCGAGGCT
```

TRP2 #19
```
  D  P  T  L  I  S  R  N  S  R  F  S  S  W  E  T  V  C  D  S  L  D  D  Y  N  H  L  V  T  L
GACCCTACCCTCATCTCCAGGAATAGCAGATTCTCCAGCTGGGAGACAGTGTGTGACTCCCTGGATGACTATAACCATCTGGTCACCCTC
```

MUC1F #8
```
  T  R  P  A  L  G  S  T  T  P  P  A  H  D  V  T  S  A  P  D  N  K  A  A
ACCAGACCCGCTCTGGGAAGCACAACCCCTCCCGCTCACGATGTGACAAGCGCTCCCGATAACAAAGCCGCT
```

Tyros #17
```
  R  D  A  E  K  C  D  I  C  T  D  E  Y  M  G  G  Q  H  P  T  N  P  N  L  L  S  P  A  S  F
AGGGATGCCGAAAAGTGTGACATTTGCACAGACGAATACATGGGCGGACAGCATCCCACAAACCCTAACCTCCTGTCCCCCGCTAGCTTT
``` gp100 #17
```
  T  F  A  L  Q  L  H  D  P  S  G  Y  L  A  E  A  D  L  S  Y  T  W  D  F  G  D  S  S  G  T
ACCTTTGCCCTCCAGCTCCACGATCCCTCCGGCTATCTGGCTGAGGCTGACCTCAGCTATACCTGGGACTTTGGCGATAGCTCCGGCACA
```

Tyros #22
```
  S  S  A  D  V  E  F  C  L  S  L  T  Q  Y  E  S  G  S  M  D  K  A  A  N  F  S  F  R  N  T
AGCTCCGCCGATGTGGAATTCTGTCTGTCCCTGACACAGTATGAGTCCGGCTCCATGGATAAGGCTGCCAATTTCTCCTTCAGAAACACA
``` gp100 #6
```
  G  P  T  L  I  G  A  N  A  S  F  S  I  A  L  N  F  P  G  S  Q  K  V  L  P  D  G  Q  V  I
GGCCCTACCCTCATCGGAGCCAATGCCTCCTTCTCCATCGCTCTGAATTTCCCTGGCTCCCAGAAAGTGCTCCCCGATGGCCAAGTGATT
```

MC1R #18
```
  W  G  P  F  F  L  H  L  T  L  I  V  L  C  P  E  H  P  T  C  G  C  I  F  K  N  F  N  L  F
TGGGGACCCTTTTTCCTCCACCTCACCCTCATCGTCCTGTGTCCCGAACACCCTACCTGTGGCTGTATCTTTAAGAATTTCAATCTGTTT
```

Tyros #7
```
  C  Q  C  S  G  N  F  M  G  F  N  C  G  N  C  K  F  G  F  W  G  P  N  C  T  E  R  R  L  L
TGCCAATGCTCCGGCAATTTCATGGGCTTTAACTGTGGCAATTGCAAATTCGGATTCTGGGGCCCTAACTGTACCGAAAGGAGACTGCTC
```

TRP2 #34
```
  Q  Y  R  R  L  R  K  G  Y  T  P  L  M  E  T  H  L  S  S  K  R  Y  T  E  E  A  A  A
CAGTATAGGAGACTGAGAAAGGGATACACACCCCTCATGGAAACCCATCTGTCCAGCAAAAGGTATACCGAAGAGGCTGCCGCT
```

TRP-1 #15
```
  P  L  E  N  A  P  I  G  H  N  R  Q  Y  N  M  V  P  F  W  P  P  V  T  N  T  E  M  F  V  T
CCCCTCGAGAATGCCCCTATCGGACACAATAGGCAATACAATATGGTCCCCTTTTGGCCTCCCGTCACCAATACCGAAATGTTTGTGACA
``` gp100 #7
```
  N  F  P  G  S  Q  K  V  L  P  D  G  Q  V  I  W  V  N  N  T  I  I  N  G  S  Q  V  W  G  G
AACTTTCCCGGAAGCCAAAAGGTCCTGCCTGACGGACAGGTCATCTGGGTGAATAACACAATCATTAACGGAAGCCAAGTGTGGGGCGGA
``` gp100 #22
```
  R  P  T  A  E  A  P  N  T  T  A  G  Q  V  P  T  T  E  V  V  G  T  T  P  G  Q  A  P  T  A
AGGCCTACCGCTGAGGCTCCCAATACCACAGCCGGACAGGTCCCCACAACCGAAGTGGTCGGCACAACCCCTGGCCAAGCCCCTACCGCT
```

MUC1F #3
```
  S  T  P  G  G  E  K  E  T  S  A  T  Q  R  S  S  V  P  S  S  T  E  K  N  A  V  S  M  T  S
AGCACACCCGGAGGCGAAAAGGAAACCTCCGCCACACAGAGAAGCTCCGTGCCTAGCTCCACCGAAAAGAATGCCGTCAGCATGACCTCC
``` gp100 #42
```
  L  I  Y  R  R  R  L  M  K  Q  D  F  S  V  P  Q  L  P  H  S  S  S  H  W  L  R  L  P  R  I
CTGATTTACAGAAGGAGACTGATGAAGCAAGACTTTAGCGTCCCCCAACTGCCTCACTCCAGCTCCCACTGGCTGAGACTGCCTAGGATT
```

TRP2 #12
```
  L  G  L  L  G  P  N  G  T  Q  P  Q  F  A  N  C  S  V  Y  D  F  F  V  W  L  H  Y  Y  S  V
CTGGGACTGCTCGGCCCTAACGGAACCCAACCCCAATTCGCTAACTGTAGCGTCTACGATTTCTTTGTGTGGCTGCATTACTATAGCGTC
```

TRP-1 #9
```
  C  L  E  V  G  L  F  D  T  P  P  F  Y  S  N  S  T  N  S  F  R  N  T  V  E  G  Y  S  D  P
TGCCTCGAGGTCGGCCTCTTCGATACCCCTCCCTTTTACTCCAACTCCACCAATAGCTTTAGGAATACCGTCGAGGGATACTCCGACCCT
``` gp100 #1
```
  A  A  M  D  L  V  L  K  R  C  L  L  H  L  A  V  I  G  A  L  L  A  V  G  A  T  K  V  P  R
GCCGCTATGGATCTGGTCCTGAAAAGGTGTCTGCTCCACCTCGCCGTCATCGGAGCCCTCCTGGCTGTGGGAGCCACAAAGGTCCCCAGA
```

```
AACCAAACCGGAGCCAGATGCCTCGAGGTCAGCATTAGCGATGGCCTCTTCCTCAGCCTCGGCCTCGTGTCCCTGGTCGAGAATGCCCTC

Tyros #23
  S  G  S  M  D  K  A  A  N  F  S  F  R  N  T  L  E  G  F  A  S  P  L  T  G  I  A  D  A  S
AGCGGAAGCATGGACAAAGCCGCTAACTTTAGCTTTAGGAATACCCTCGAGGGATTCGCTAGCCCTCTGACAGGCATTGCCGATGCCTCC Tyros #4
  S  P  C  G  Q  L  S  G  R  G  S  C  Q  N  I  L  L  S  N  A  P  L  G  P  Q  F  P  F  T  G
AGCCCTTGCGGACAGCTCAGCGGAAGGGGAAGCTGTCAGAATATCCTCCTGTCCAACGCTCCCCTCGGCCCTCAGTTTCCCTTTACCGGA Tyros #13
  M  H  Y  Y  V  S  M  D  A  L  L  G  G  S  E  I  W  R  D  I  D  F  A  H  E  A  P  A  F  L
ATGCATTACTATGTGTCCATGGATGCCCTCCTGGGAGGCTCCGAGATTTGGAGAGACATTGACTTTGCCCATGAGGCTCCCGCTTTCCTC Tyros #35
  E  E  K  Q  P  L  L  M  E  K  E  D  Y  H  S  L  Y  Q  S  H  L  A  A
GAGGAAAAGCAACCCCTCCTGATGGAGAAAGAGGATTACCATAGCCTCTACCAAAGCCATCTGGCTGCC TRP2 #5
  G  Q  C  T  E  V  R  A  D  T  R  P  W  S  G  P  Y  I  L  R  N  Q  D  D  R  E  L  W  P  R
GGCCAATGCACAGAGGTCAGGGCTGACACAAGGCCTTGGTCCGGCCCTTACATTCTGAGAAACCAAGACGATAGGGAACTGTGGCCCAGA MUC1F #4
  S  V  P  S  S  T  E  K  N  A  V  S  M  T  S  S  V  L  S  S  H  S  P  G  S  G  S  S  T  T
AGCGTCCCCTCCAGCACAGAGAAAAACGCTGTGTCCATGACAAGCTCCGTGCTCAGCTCCCACTCCCCCGGAAGCGGAAGCTCCACCACA Tyros #12
  T  P  M  F  N  D  I  N  I  Y  D  L  F  V  W  M  H  Y  Y  V  S  M  D  A  L  L  G  G  S  E
ACCCCTATGTTTAACGATATCAATATCTATGACCTCTTCGTCTGGATGCACTATTACGTCAGCATGGACGCTCTGCTCGGCGGAAGCGAA gp100 #9
  Q  P  V  Y  P  Q  E  T  D  D  A  C  I  F  P  D  G  G  P  C  P  S  G  S  W  S  Q  K  R  S
CAGCCTGTGTATCCCCAAGAGACAGACGATGCCTGTATCTTTCCCGATGGCGGACCCTGTCCCTCCGGCTCCTGGTCCCAGAAAAGGTCC TRP-1 #6
  D  S  L  E  D  Y  D  T  L  G  T  L  C  N  S  T  E  D  G  P  I  R  R  N  P  A  G  N  V  A
GACTCCCTGGAAGACTATGACACACTGGGAACCCTCTGCAATAGCACAGAGGATGGCCCTATCAGAAGGAATCCCGCTGGCAATGTGGCT gp100 #8
  W  V  N  N  T  I  I  N  G  S  Q  V  W  G  G  Q  P  V  Y  P  Q  E  T  D  D  A  C  I  F  P
TGGGTCAACAATACCATTATCAATGGCTCCCAGGTCTGGGGAGGCCAACCCGTCTACCCTCAGGAAACCGATGACGCTTGCATTTTCCCT MART #7
  Q  E  K  N  C  E  P  V  V  P  N  A  P  P  A  Y  E  K  L  S  A  E  Q  S  P  P  P  Y  S  P
CAGGAAAAGAATTGCGAACCCGTCGTGCCTAACGCTCCCCCTGCCTATGAGAAACTGTCCGCCGAACAGTCCCCCCCTCCCTATAGCCCT gp100 #14
  S  R  S  Y  V  P  L  A  H  S  S  S  A  F  T  I  T  D  Q  V  P  F  S  V  S  V  S  Q  L  R
AGCAGAAGCTATGTGCCTCTGGCTCACTCCAGCTCCGCCTTTACCATTACCGATCAGGTCCCCTTTAGCGTCAGCGTCAGCCAACTGAGA TRP-1 #2
  L  E  K  D  M  Q  E  M  L  Q  E  P  S  F  S  L  P  Y  W  N  F  A  T  G  K  N  V  C  D  I
CTGGAAAAGGATATGCAAGAGATGCTGCAAGAGCCTAGCTTTAGCCTCCCCTATTGGAATTTCGCTACCGGAAAGAATGTGTGTGACATT TRP-1 #16
  V  P  F  W  P  P  V  T  N  T  E  M  F  V  T  A  P  D  N  L  G  Y  T  Y  E  A  A
GTGCCTTTCTGGCCCCCTGTGACAAACACAGAGATGTTCGTCACCGCTCCCGATAACCTCGGCTATACCTATGAGGCTGCC TRP2 #13
  C  S  V  Y  D  F  F  V  W  L  H  Y  Y  S  V  R  D  T  L  L  G  P  G  R  P  Y  R  A  I  D
TGCTCCGTGTATGACTTTTTCGTCTGGCTCCACTATTACTCCGTGAGAGACACACTGCTCGGCCCTGGCAGACCCTATAGGGCTATCGAT Tyros #9
  V  R  R  N  I  F  D  L  S  A  P  E  K  D  K  F  F  A  Y  L  T  L  A  K  H  T  I  S  S  D
GTGAGAAGGAATATCTTTGACCTCAGCGCTCCCGAAAAGGATAAGTTTTTCGCTTACCTCACCCTCGCCAAACACACAATCTCCAGCGAT MART #2
  K  K  G  H  G  H  S  Y  T  T  A  E  E  A  A  G  I  G  I  L  T  V  I  L  G  V  L  L  L  I
AAGAAAGGCCATGGCCATAGCTATACCACAGCCGAAGAGGCTGCCGGAATCGGAATCCTCACCGTCATCCTCGGCGTCCTGCTCCTGATT gp100 #11
  F  V  Y  V  W  K  T  W  G  Q  Y  W  Q  V  L  G  G  P  V  S  G  L  S  I  G  T  G  R  A  M
```

Figure 27 (Cont)

TTCGTCTACGTCTGGAAAACCTGGGGCCAATACTGGCAGGTCCTGGGAGGCCCTGTGTCCGGCCTCAGCATTGGCACAGGCAGAGCCATG gp100 #12
G G P V S G L S I G T G R A M L G T H T M E V T V Y H R R G
GGCGGACCCGTCAGCGGACTGTCCATCGGAACCGGAAGGGCTATGCTCGGCACACACACAATGGAAGTGACAGTGTATCACAGAAGGGGA gp100 #25
I S T A P V Q M P T A E S T G M T P E K V P V S E V M G T T
ATCTCCACCGCTCCCGTCCAGATGCCCACAGCCGAAAGCACAGGCATGACCCCTGAGAAAGTGCCTGTGTCCGAGGTCATGGGAACCACA

Tyros #19
F S S W Q I V C S R L E E Y N S H Q S L C N G T P E G P L R
TTCTCCAGCTGGCAGATTGTGTGTAGCAGACTGGAAGAGTATAACTCCCACCAAAGCCTCTGCAATGGCACACCCGAAGGCCCTCTGAGA TRP2 #27
D P I F V V L H S F T D A I F D E W M K R F N P P A D A W P
GACCCTATCTTTGTGGTCCTGCATAGCTTTACCGATGCCATTTTCGATGAGTGGATGAAAAGGTTTAACCCTCCCGCTGACGCTTGGCCT MC1R #15
H M L A R A C Q H A Q G I A R L H K R Q R P V H Q G F G L K
CACATGCTGGCTAGGGCTTGCCAACACGCTCAGGGAATCGCTAGGCTCCACAAAAGGCAAAGGCCTGTGCATCAGGGATTCGGACTGAAA MUC1F #2
L L T V L T V V T G S G H A S S T P G G E K E T S A T Q R S
CTGCTCACCGTCCTGACAGTGGTCACCGGAAGCGGACACGCTAGCTCCACCCCTGGCGGAGAGAAAGAGACAAGCGCTACCCAAAGGTCC gp100 #44
F C S C P I G E N S P L L S G Q Q V A A
TTCTGTAGCTGTCCCATTGGCGAAAAACTCCCCCCTCCTGTCCGGCCAACAGGTCGCCGCT TRP2 #24
T F S F R N A L E G F D K A D G T L D S Q V M S L H N L V H
ACCTTTAGCTTTAGGAATGCCCTCGAGGGATTCGATAAGGCTGACGGAACCCTCGACTCCCAGGTCATGTCCCTGCATAACCTCGTGCAT Tyros #20
S H Q S L C N G T P E G P L R R N P G N H D K S R T P R L P
AGCCATCAGTCCCTGTGTAACGGAACCCCTGAGGGACCCCTCAGGAGAAACCCTGGCAATCACGATAAGTCCAGGACACCCAGACTGCCT TRP2 #30
P F F P P V T N E E L F L T S D Q L G Y S Y A I D L P V S V
CCCTTTTTTCCCTCCCGTCACCAATGAGGAACTGTTTCTGACAAGCGATCAGCTCGGCTATAGCTATGCCATTGACCTCCCCGTCAGCGTC TRP2 #9
E R K K P P V I R Q N I H S L S P Q E R E Q F L G A L D L A
GAGAGAAAGAAACCCCCTGTGATTAGGCAAAACATTCACTCCCTGTCCCCCCAAGAGAGAGAGCAATTCCTCGGCGCTCTGGATCTGGCT TRP2 #29
Q E L A P I G H N R M Y N M V P F F P P V T N E E L F L T S
CAGGAACTGGCTCCCATTGGCCATAACAGAATGTATAACATGGTGCCTTTCTTTCCCCCTGTGACAAACGAAGAGCTCTTCCTCACCTCC gp100 #28
E V S I V V L S G T T A A Q V T T T E W V E T T A R E L P I
GAGGTCAGCATTGTGGTCCTGTCCGGCACAACCGCTGCCCAAGTGACAACCACAGAGTGGGTGGAAACCACAGCCAGAGAGCTCCCCATT MUC1R #7
T S P Q L S T G V S F F F L S F H I S N L Q F N S S L E D P
ACCTCCCCCCAACTGTCCACCGGAGTGTCCTTCTTTTTCCTCAGCTTTCACATTAGCAATCTGCAATTCAATAGCTCCCTGGAAGACCCT MUC1R #19
Y H T H G R Y V P P S S T D R S P Y E K V S A G N G G S S L
TACCATACCCATGGCAGATACGTCCCCCCTAGCTCCACCGATAGGTCCCCCTATGAGAAAGTGTCCGCCGGAAACGGAGGCTCCAGCCTC MC1R #4
L F L S L G L V S L V E N A L V V A T I A K N R N L H S P M
CTGTTTCTGTCCCTGGGACTGGTCAGCCTCGTGGAAAACGCTCTGGTCGTGGCTACCATTGCCAAAAACAGAAACCTCCACTCCCCCATG TRP2 #26
S F L N G T N A L P H S A A N D P I F V V L H S F T D A I F
AGCTTTCTGAATGGCACAAACGCTCTGCCTCACTCCGCCGCTAACGATCCCATTTTCGTCGTGCTCCACTCCTTCACAGACGCTATCTTT

MUC1R #17
A V C Q C R R K N Y G Q L D I F P A R D T Y H P M S E Y P T

Figure 27 (Cont)

```
GCCGTCTGCCAATGCAGAAGGAAAAACTATGGCCAACTGGATATCTTTCCCGCTAGGGATACCTATCACCCTATGTCCGAGTATCCCACA
```

MC1R #14
```
     V  P  P  L  A  M  L  V  L  M  A  V  L  Y  V  H  M  L  A  R  A  C  Q  H  A  Q  G  I  A  R
GTGTTTTTCCTCGCCATGCTGGTCCTGATGGCCGTCCTGTATGTGCATATGCTCGCCAGAGCCTGTCAGCATGCCCAAGGCATTGCCAGA
```

TRP-1 #10
```
     S  T  N  S  F  R  N  T  V  E  G  Y  S  D  P  T  G  K  Y  D  P  A  V  R  S  L  H  N  L  A
AGCACAAACTCCTTCAGAAACACAGTGGAAGGCTATAGCGATCCCACAGGCAAATACGATCCCGCTGTGAGAAGCCTCCACAATCTGGCT
```

TRP-1 #3
```
     L  P  Y  W  N  F  A  T  G  K  N  V  C  D  I  C  T  D  D  L  M  G  S  R  S  N  F  D  S  T
CTGCCTTACTGGAACTTTGCCACAGGCAAAAACGTCTGCGATATCTGTACCGATGACCTCATGGGAAGCAGAAGCAATTTCGATAGCACA
``` gp100 #15
```
     I  T  D  Q  V  P  F  S  V  S  V  S  Q  L  R  A  L  D  G  G  N  K  H  F  L  R  N  Q  P  L
ATCACAGACCAAGTGCCTTTCTCCGTGTCCGTGTCCCAGCTCAGGGCTCTGGATGGCGGAAACAAACACTTTCTGAGAAACCAACCCCTC
```

MUC1R #8
```
     F  H  I  S  N  L  Q  F  N  S  S  L  E  D  P  S  T  D  Y  Y  Q  E  L  Q  R  D  I  S  E  M
TTCCATATCTCCAACCTCCAGTTTAACTCCAGCCTCGAGGATCCCTCCACCGATTACTATCAGGAACTGCAAAGGGATATCTCCGAGATG
```

MUC1R #20
```
     S  P  Y  E  K  V  S  A  G  N  G  G  S  S  L  S  Y  T  N  P  A  V  A  A  A  S  A  N  L  A
AGCCCTTACGAAAAGGTCAGCGCTGGCAATGGCGGAAGCTCCCTGTCCTACACAAACCCTGCCGTCGCCGCTGCCTCCGCCAATCTGGCT
```

Tyros #11
```
     Y  V  I  P  I  G  T  Y  G  Q  M  K  N  G  S  T  P  M  F  N  D  I  N  I  Y  D  L  F  V  W
TACGTCATCCCTATCGGAACCTATGGCCAAATGAAAAACGGAAGCACACCCATGTTCAATGACATTAACATTTACGATCTGTTTGTGTGG
``` gp100 #37
```
     R  L  C  Q  P  V  L  P  S  P  A  C  Q  L  V  L  H  Q  I  L  K  G  G  S  G  T  Y  C  L  N
AGGCTCTGCCAACCCGTCCTGCCTAGCCCTGCCTGTCAGCTCGTGCTCCACCAAATCCTCAAGGGAGGCTCCGGCACATACTGTCTGAAT
``` gp100 #33
```
     R  Y  G  S  F  S  V  T  L  D  I  V  Q  G  I  E  S  A  E  I  L  Q  A  V  P  S  G  E  G  D
AGGTATGGCTCCTTCTCCGTGACACTGGATATCGTCCAGGGAATCGAAAGCGCTGAGATTCTGCAAGCCGTCCCCTCCGGCGAAGGCGAT
```

Tyros #27
```
     H  H  A  F  V  D  S  I  F  E  Q  W  L  Q  R  H  R  P  L  Q  E  V  Y  P  E  A  N  A  P  I
CACCATGCCTTTGTGGATAGCATTTTCGAACAGTGGCTGCAAAGGCATAGGCCTCTGCAAGAGGTCTACCCTGAGGCTAACGCTCCCATT
```

TRP-1 #4
```
     C  T  D  D  L  M  G  S  R  S  N  F  D  S  T  L  I  S  P  N  S  V  P  S  Q  W  R  V  V  C
TGCACAGACGATCTGATGGGCTCCAGGTCCAACTTTGACTCCACCCTCATCTCCCCCAATAGCGTCTTCTCCCAGTGGAGGGTCGTGTGT
```

MUC1R #18
```
     F  P  A  R  D  T  Y  H  P  M  S  E  Y  P  T  Y  H  T  H  G  R  Y  V  P  P  S  S  T  D  R
TTCCCTGCCAGAGACACATACCATCCCATGAGCGAATACCCTACCTATCACACACACGGAAGGTATGTGCCTCCCTCCAGCACAGACAGA
```

MUC1R #21
```
     S  Y  T  N  P  A  V  A  A  A  S  A  N  L  A  A
AGCTATACCAATCCCGCTGTGGCTGCCGCTAGCGCTAACCTCGCCGCT
```

MC1R #19
```
     E  H  P  T  C  G  C  I  F  K  N  F  N  L  F  L  A  L  I  I  C  N  A  I  I  D  P  L  I  Y
GAGCATCCCACATGCGGATGCATTTTCAAAAACTTTAACCTCTTCCTCGCCCTCATCATTTGCAATGCCATTATCGATCCCCTCATCTAT
```

Tyros #26
```
     M  S  Q  V  Q  G  S  A  N  D  P  I  F  L  L  H  H  A  F  V  D  S  I  F  E  Q  W  L  Q  R
ATGTCCCAGGTCCAGGGAAGCGCTAACGATCCCATTTTCCTCCTGCATCACGCTTTCGTCGACTCCATCTTTGAGCAATGGCTCCAGAGA
```

TRP2 #22
```
     R  N  S  M  K  L  P  T  L  K  D  I  R  D  C  L  S  L  Q  K  F  D  N  P  P  F  F  Q  N  S
AGGAATAGCATGAAGCTCCCCACACTGAAAGACATTAGGGATTGCCTCAGCCTCCAGAAATTCGATAACCCTCCCTTTTTCCAAAACTCC
``` gp100 #19
```
     L  I  S  R  A  L  V  V  T  H  T  Y  L  E  P  G  P  V  T  A  Q  V  V  L  Q  A  A  I  P  L
CTGATTAGCAGAGCCCTCGTGGTCACCCATACCTATCTGGAACCCGGACCCGTCACCGCTCAGGTCGTGCTCCAGGCTGCCATTCCCCTC
```

TRP2 #17
```
     S  F  A  L  P  Y  W  N  F  A  T  G  R  N  E  C  D  V  C  T  D  Q  L  F  G  A  A  R  P  D
```

Figure 27 (Cont)

AGCTTTGCCCTCCCCTATTGGAATTTCGCTACCGGAAGGAATGAGTGTGACGTCTGCACAGACCAACTGTTTGGCGCTGCCAGACCCGAT gp100 #2
V I G A L L A V G A T K V P R N Q D W L G V S R Q L R T K A
GTGATTGGCGCTCTGCTCGCCGTCGGCGCTACCAAAGTGCCTAGGAATCAGGATTGGCTCGGCGTCAGCAGACAGCTCAGGACAAAGGCT gp100 #16
A L D G G N K H F L R N Q P L T F A L Q L H D P S G Y L A E
GCCCTCGACGGAGGCAATAAGCATTTCCTCAGGAATCAGCCTCTGACATTCGCTCTGCAACTGCATGACCCTAGCGGATACCTCGCCGAA

TRP2 #18
C D V C T D Q L F G A A R P D D P T L I S R N S R F S S W E
TGCGATGTGTGTACCGATCAGCTCTTCGGAGCCGCTAGGCCTGACGATCCCACACTGATTAGCAGAAACTCCAGGTTTAGCTCCTGGGAA

MART #1
A A M P R E D A H F I Y G Y P K K G H G H S Y T T A E E A A
GCCGCTATGCCTAGGGAAGACGCTCACTTTATCTATGGCTATCCCAAAAAGGGACACGGACACTCCTACACAACCGCTGAGGAAGCCGCT

TRP-1 #11
T G K Y D P A V R S L H N L A H L F L N G T G G Q T H L S S
ACCGGAAAGTATGACCCTGCCGTCAGGTCCCTGCATAACCTCGCCCATCTGTTTCTGAATGGCACAGGCGGACAGACACACCTCAGCTCC

MUC1R #14
S D V S V S D V P F P F S A Q S G A G V P G W G I A L L V L
AGCGATGTGTCCGTGTCCGACGTCCCCTTTCCCTTTAGCGCTCAGTCCGGCGCTGGCGTCCCCGGATGGGGAATCGCTCTGCTCGTGCTC

TRP2 #10
S P Q E R E Q F L G A L D L A K K R V H P D Y V I T T Q H W
AGCCCTCAGGAAAGGGAACAGTTTCTGGGAGCCCTCGACCTCGCCAAAAAGAGAGTGCATCCCGATTACGTCATCACAACCCAACACTGG

Tyros #10
F F A Y L T L A K H T I S S D Y V I P I G T Y G Q M K N G S
TTCTTTGCCTATCTGACACTGGCTAAGCATACCATTAGCTCCGACTATGTGATTCCCATTGGCACATACGGACAGATGAAGAATGGCTCC MC1R #7
G T N V L E T A V I L L L E A G A L V A R A A V L Q Q L D N
GGCACAAACGTCCTGGAAACCGCTGTGATTCTGCTCCTGGAAGCCGGAGCCCTCGTGGCTAGGGCTGCCGTCCTGCAACAGCTCGACAAT MUC1R #16
V C V L V A L A I V Y L I A L A V C Q C R R K N Y G Q L D I
GTGTGTGTGCTCGTGGCTCTGGCTATCGTCTACCTCATCGCTCTGGCTGTGTGTCAGTGTAGGAGAAAGAATTACGGACAGCTCGACATT MART #6
C P Q E G F D H R D S K V S L Q E K N C E P V V P N A P P A
TGCCCTCAGGAAGGCTTTGACCATAGGGATAGCAAAGTGTCCCTGCAAGAGAAAAACTGTGAGCCTGTGGTCCCCAATGCCCCTCCCGCT MUC1F #5
S V L S S H S P G S G S S T T Q G Q D V T L A P A T E P A S
AGCGTCCTGTCCAGCCATAGCCCTGGCTCCGGCTCCAGCACAACCCAAGGCCAAGACGTCACCCTCGCCCCTGCCACAGAGCCTGCCTCC TRP2 #28
D E W M K R F N P P A D A W P Q E L A P I G H N R M Y N M V
GACGAATGGATGAAGAGATTCAATCCCCCTGCCGATGCCTGGCCCCAAGAGCTCGCCCCTATCGGACACAATAGGATGTACAATATGGTC MC1R #21
A F H S Q E L R R T L K E V L T C S W A A
GCCTTTCACTCCCAGGAACTGAGAAGGACACTGAAAGAGGTCCTGACATGCTCCTGGGCTGCC TRP2 #15
F S H Q G P A F V T W H R Y H L L C L E R D L Q R L I G N E
TTCTCCCACCAAGGCCCTGCCTTTGTGACATGGCATAGGTATCACCTCCTGTGTCTGGAAAGGGATCTGCAAAGGCTCATCGGAAACGAA TRP-1 #8
R P M V Q R L P E P Q D V A Q C L E V G L F D T P P F Y S N
AGGCCTATGGTCCAGAGACTGCCTGAGCCTCAGGATGTGGCTCAGTGTCTGGAAGTGGGACTGTTTGACACACCCCCTTTCTATAGCAAT TRP-1 #13
Q D P I F V L L H T F T D A V F D E W L R R Y N A D I S T F
CAGGATCCCATTTTCGTCCTGCTCCACACATTCACAGACGCTGTGTTTGACGAATGGCTCAGGAGATACAATGCCGATATCTCCACCTTT

TRP2 #4
L G A E S A N V C G S Q Q G R G Q C T E V R A D T R P W S G

Figure 27 (Cont)

```
CTGGGAGCCGAAAGCGCTAACGTCTGCGGAAGCCAACAGGGAAGGGGACAGTGTACCGAAGTGAGAGCCGATACCAGACCCTGGAGCGGA
```

TRP2 #8
```
  Y  N  C  G  D  C  K  F  G  W  T  G  P  N  C  E  R  K  K  P  P  V  I  R  Q  N  I  H  S  L
TACAATTGCGGAGACTGTAAGTTTGGCTGGACCGGACCCAATTGCGAAAGGAAAAAGCCTCCCGTCATCAGACAGAATATCCATAGCCTC
```

TRP-1 #12
```
  H  L  F  L  N  G  T  G  G  Q  T  H  L  S  S  Q  D  P  I  F  V  L  L  H  T  F  T  D  A  V
CACCTCTTCCTCAACGGAACCGGAGGCCAAACCCATCTGTCCAGCCAAGACCCTATCTTTGTGCTCCTGCATACCTTTACCGATGCCGTC
```

Tyros #34
```
  G  L  V  S  L  L  C  R  H  K  R  K  Q  L  P  E  E  K  Q  P  L  L  M  E  K  E  D  Y  H  S
GGCCTCGTGTCCCTGCTCTGCAGACACAAAAGGAAACAGCTCCCCGAAGAGAAACAGCCTCTGCTCATGGAAAAGGAAGACTATCACTCC
```

TRP2 #2
```
  G  C  K  I  L  P  G  A  Q  G  Q  F  P  R  V  C  M  T  V  D  S  L  V  N  K  E  C  C  P  R
GGCTGTAAGATTCTGCCTGGCGCTCAGGGACAGTTTCCCAGAGTGTGTATGACAGTGGATAGCCTCGTGAATAAGGAATGCTGTCCCAGA
``` gp100 #43
```
  Q  L  P  H  S  S  S  H  W  L  R  L  P  R  I  F  C  S  C  P  I  G  E  N  S  P  L  L  S  G
CAGCTCCCCCATAGCTCCAGCCATTGGCTCAGGCTCCCCAGAATCTTTTGCTCCTGCCCTATCGGAGAGAATAGCCCTCTGCTCAGCGGA
``` gp100 #10
```
  D  G  G  P  C  P  S  G  S  W  S  Q  K  R  S  F  V  Y  V  W  K  T  W  G  Q  Y  W  Q  V  L
GACGGAGGCCCTTGCCCTAGCGGAAGCTGGAGCCAAAAGAGAAGCTTTGTGTATGTGTGGAAGACATGGGGACAGTATTGGCAAGTGCTC
``` gp100 #3
```
  N  Q  D  W  L  G  V  S  R  Q  L  R  T  K  A  W  N  R  Q  L  Y  P  E  W  T  E  A  Q  R  L
AACCAAGACTGGCTGGGAGTGTCCAGGCAACTGAGAACCAAAGCCTGGAACAGACAGCTCTACCCTGAGTGGACCGAAGCCCAAAGGCTC
```

Tyros #14
```
  I  W  R  D  I  D  F  A  H  E  A  P  A  F  L  P  W  H  R  L  F  L  L  R  W  E  Q  E  I  Q
ATCTGGAGGGATATCGATTTCGCTCACGAAGCCCCTGCCTTTCTGCCTTGGCATAGGCTCTTCCTCCTGAGATGGGAACAGGAAATCCAA
```

MUC1F #1
```
  A  A  M  T  P  G  T  Q  S  P  F  F  L  L  L  L  L  T  V  L  T  V  V  T  G  S  G  H  A  S
GCCGCTATGACACCCGGAACCCAAAGCCCTTTCTTTCTGCTCCTGCTCCTGACAGTGCTCACCGTCGTGACAGGCTCCGGCCATGCCTCC
```

MART #5
```
  D  K  S  L  H  V  G  T  Q  C  A  L  T  R  R  C  P  Q  E  G  F  D  H  R  D  S  K  V  S  L
GACAAAAGCCTCCACGTCGGCACACAGTGTGCCCTCACCAGAAGGTGTCCCCAAGAGGGATTCGATCACAGAGACTCCAAGGTCAGCCTC
```

MUC1R #2
```
  N  V  T  S  A  S  G  S  A  S  G  S  A  S  T  L  V  H  N  G  T  S  A  R  A  T  T  T  P  A
AACGTCACCTCCGCCTCCGGCTCCGCCTCCGGCTCCGCCTCCACCCTCGTGCATAACGGAACCTCCGCCAGAGCCACAACCACACCCGCT
```

Tyros #24
```
  L  E  G  F  A  S  P  L  T  G  I  A  D  A  S  Q  S  S  M  H  N  A  L  H  I  Y  M  N  G  T
CTGGAAGGCTTTGCCTCCCCCCTCACCGGAATCGCTGACGCTAGCCAAAGCTCCATGCATAACGCTCTGCATATCTATATGAATGGCACA
```

TRP2 #14
```
  R  D  T  L  L  G  P  G  R  P  Y  R  A  I  D  F  S  H  Q  G  P  A  F  V  T  W  H  R  Y  H
AGGGATACCCTCCTGGGACCCGGAAGGCCTTACAGAGCCATTGACTTTAGCCATCAGGGACCCGCTTTCGTCACCTGGCACAGATACCAT
```

Tyros #1
```
  A  A  M  L  L  A  V  L  Y  C  L  L  W  S  F  Q  T  S  A  G  H  F  P  R  A  C  V  S  S  K
GCCGCTATGCTCCTGGCTGTGCTCTACTGTCTGCTCTGGTCCTTCCAAACCTCCGCCGGACACTTTCCCAGAGCCTGTGTGTCCAGCAAA
``` gp100 #35
```
  A  F  E  L  T  V  S  C  Q  G  G  L  P  K  E  A  C  M  E  I  S  S  P  G  C  Q  P  P  A  Q
GCCTTTGAGCTCACCGTCAGCTGTCAGGGAGGCCTCCCCAAAGAGGCTTGCATGGAGATTAGCTCCCCCGGATGCCAACCCCCTGCCCAA
```

Tyros #6
```
  V  D  D  R  E  S  W  P  S  V  F  Y  N  R  T  C  Q  C  S  G  N  F  M  G  F  N  C  G  N  C
GTGGATGACAGAGAGTCCTGGCCTAGCGTCTTCTATAACAGAACCTGTCAGTGTAGCGGAAACTTTATGGGATTCAATTGCGGAAACTGT
``` gp100 #34
```
  E  S  A  E  I  L  Q  A  V  P  S  G  E  G  D  A  F  E  L  T  V  S  C  Q  G  G  L  P  K  E
GAGTCCGCCGAAATCCTCCAGGCTGTGCCTAGCGGAGAGGGAGACGCTTTCGAACTGACAGTGTCCTGCCAAGGCGGACTGCCTAAGGAA
```

TRP2 #20
```
  T  V  C  D  S  L  D  D  Y  N  H  L  V  T  L  C  N  G  T  Y  E  G  L  L  R  R  N  Q  M  G
```

Figure 27 (Cont)

ACCGTCTGCGATAGCCTCGACGATTACAATCACCTCGTGACACTGTGTAACGGAACCTATGAGGGACTGCTCAGGAGAAACCAAATGGGA

Tyros #5
L L S N A P L G P Q F P F T G V D D R E S W P S V F Y N R T
CTGCTCAGCAATGCCCCTCTGGGACCCCAATTCCCTTTCACAGGCGTCGACGATAGGGAAAGCTGGCCCTCCGTGTTTTACAATAGGACA MART #8
Y E K L S A E Q S P P P Y S P A A
TACGAAAAGCTCAGCGCTGAGCAAAGCCCTCCCCCTTACTCCCCCGCTGCC gp100 #41
I V G I L L V L M A V V L A S L I Y R R R L M K Q D F S V P
ATCGTCGGCATTCTGCTCGTGCTCATGGCTGTGGTCCTGGCTAGCCTCATCTATAGGAGAAGGCTCATGAAACAGGATTTCTCCGTGCCT MART #3
G I G I L T V I L G V L L L I G C W Y C R R R N G Y R A L M
GGCATTGGCATTCTGACAGTGATTCTGGGAGTGCTCCTGCTCATCGGATGCTGGTACTGTAGGAGAAGGAATGGCTATAGGGCTCTGATG Tyros #31
Y S Y L Q D S D P D S F Q D Y I K S Y L E Q A S R I W S W L
TACTCCTACCTCCAGGATAGCGATCCCGATAGCTTTCAGGATTACATTAAGTCCTACCTCGAGCAAGCCTCCAGGATTTGGTCCTGGCTC MUC1F #6
Q G Q D V T L A P A T E P A S G S A A T W G Q D V T S V P V
CAGGGACAGGATGTGACACTGGCTCCCGCTACCGAACCCGCTAGCGGAAGCGCTGCCACATGGGGACAGGATGTGACAAGCGTCCCCGTC gp100 #21
T S C G S S P V P G T T D G H R P T A E A P N T T A G Q V P
ACCTCCTGCGGAAGCTCCCCCGTCCCCGGAACCACAGACGGACACAGACCCACAGCCGAAGCCCCTAACACAACCGCTGGCCAAGTGCCT MUC1R #3
L V H N G T S A R A T T T P A S K S T P F S I P S H H S D T
CTGGTCCACAATGGCACAAGCGCTAGGGCTACCACAACCCCTGCCTCCAAGTCCACCCCTTTCTCCATCCCTAGCCATCACTCCGACACA TRP2 #32
E E T P G W P T T L L V V M G T L V A L V G L F V L L A F L
GAGGAAACCCCTGGCTGGCCCACAACCCTCCTGGTCGTGATGGGCACACTGGTCGCCCTCGTGGGACTGTTTGTGCTCCTGGCTTTCCTC gp100 #29
T T T E W V E T T A R E L P I P E P E G P D A S S I M S T E
ACCACAACCGAATGGGTCGAGACAACCGCTAGGGAACTGCCTATCCCTGAGCCTGAGGGACCCGATGCCTCCAGCATTATGTCCACCGAA MC1R #17
G A V T L T I L L G I F F L C W G P F F L H L T L I V L C P
GGCGCTGTGACACTGACAATCCTCCTGGGAATCTTTTTCCTCTGCTGGGGCCCTTTCTTTCTGCATCTGACACTGATTGTGCTCTGCCCT Tyros #33
L G A A M V G A V L T A L L A G L V S L L C R H K R K Q L P
CTGGGAGCCGCTATGGTCGGCGCTGTGCTCACCGCTCTGCTCGCCGGACTGGTCAGCCTCCTGTGTAGGCATAAGAGAAAGCAACTGCCT MC1R #8
G A L V A R A A V L Q Q L D N V I D V I T C S S M L S S L C
GGCGCTCTGGTCGCCAGAGCCGCTGTGCTCCAGCAACTGGATAACGTCATCGATGTGATTACCTGTAGCTCCATGCTCAGCTCCCTGTGT gp100 #26
M T P E K V P V S E V M G T T L A E M S T P E A T G M T P A
ATGACACCCGAAAAGGTCCCCGTCAGCGAAGTGATGGGCACAACCCTCGCCGAAATGTCCACCCCTGAGGCTACCGGAATGACACCCGCT Tyros #2
Q T S A G H F P R A C V S S K N L M E K E C C P P W S G D R
CAGACAAGCGCTGGCCATTTCCCTAGGGCTTGCGTCAGCTCCAAGAATCTGATGGAGAAAGAGTGTTGCCCTCCCTGGAGCGGAGACAGA MC1R #11
A L R Y H S I V T L P R A P R A V A A I W V A S V V F S T L
GCCCTCAGGTATCACTCCATCGTCACCCTCCCCAGAGCCCCTAGGGCTGTGGCTGCCATTTGGGTCGCCTCCGTGGTCTTCTCCACCCTC MUC1R #12
F R E G T I N V H D V E T Q F N Q Y K T E A A S R Y N L T I
TTCAGAGAGGGAACCATTAACGTCCACGATGTGGAAACCCAATTCAATCAGTATAAGACAGAGGCTGCCTCCAGGTATAACCTCACCATT Tyros #3
N L M E K E C C P P W S G D R S P C G Q L S G R G S C Q N I

Figure 27 (Cont)

```
AACCTCATGGAAAAGGAATGCTGTCCCCCTTGGTCCGGCGATAGGTCCCCCTGTGGCCAACTGTCCGGCAGAGGCTCCTGCCAAAACATT
```

Tyros #32
```
  I  K  S  Y  L  E  Q  A  S  R  I  W  S  W  L  L  G  A  A  M  V  G  A  V  L  T  A  L  L  A
ATCAAAAGCTATCTGGAACAGGCTAGCAGAATCTGGAGCTGGCTGCTCGGCGCTGCCATGGTGGGAGCCGTCCTGACAGCCCTCCTGGCT
```

MUC1R #5
```
  P  T  T  L  A  S  H  S  T  K  T  D  A  S  S  T  H  H  S  S  V  P  P  L  T  S  S  N  H  S
CCCACAACCCTCGCCTCCCACTCCACCAAAACCGATGCCTCCAGCACACACCATAGCTCCGTGCCTCCCCTCACCTCCAGCAATCACTCC
```

MUC1R #15
```
  S  G  A  G  V  P  G  W  G  I  A  L  L  V  L  V  C  V  L  V  A  L  A  I  V  Y  L  I  A  L
AGCGGAGCCGGAGTGCCTGGCTGGGGCATTGCCCTCCTGGTCCTGGTCTGCGTCCTGGTCGCCCTCGCCATTGTGTATCTGATTGCCCTC
```

MC1R #10
```
  F  L  G  A  I  A  V  D  R  Y  I  S  I  F  Y  A  L  R  Y  H  S  I  V  T  L  P  R  A  P  R
TTCCTCGGCGCTATCGCTGTGGATAGGTATATCTCCATCTTTTACGCTCTGAGATACCATAGCATTGTGACACTGCCTAGGGCTCCCAGA
``` gp100 #40
```
  L  I  M  P  G  Q  E  A  G  L  G  Q  V  P  L  I  V  G  I  L  L  V  L  M  A  V  V  L  A  S
CTGATTATGCCTGGCCAAGAGGCTGGCCTCGGCCAAGTGCCTCTGATTGTGGGAATCCTCCTGGTCCTGATGGCCGTCGTGCTCGCCTCC
```

TRP2 #33
```
  T  L  V  A  L  V  G  L  F  V  L  L  A  F  L  Q  Y  R  R  L  R  K  G  Y  T  P  L  M  E  T
ACCCTCGTGGCTCTGGTCGGCCTCTTCGTCCTGCTCGCCTTTCTGCAATACAGAAGGCTCAGGAAAGGCTATACCCCTCTGATGGAGACA
```

TRP-1 #5
```
  L  I  S  P  N  S  V  F  S  Q  W  R  V  V  C  D  S  L  E  D  Y  D  T  L  G  T  L  C  N  S
CTGATTAGCCCTAACTCCGTGTTTAGCCAATGGAGAGTGGTCTGCGATAGCCTCGAGGATTACGATACCCTCGGCACACTGTGTAACTCC
```

MC1R #2
```
  L  N  S  T  P  T  A  I  P  Q  L  G  L  A  A  N  Q  T  G  A  R  C  L  E  V  S  I  S  D  G
CTGAATAGCACACCCACAGCCATTCCCCAACTGGGACTGGCTGCCAATCAGACAGGCGCTAGGTGTCTGGAAGTGTCCATCTCCGACGGA
```

Tyros #28
```
  H  R  P  L  Q  E  V  Y  P  E  A  N  A  P  I  G  H  N  R  E  S  Y  M  V  P  F  I  P  L  Y
CACAGACCCCTCCAGGAAGTGTATCCCGAAGCCAATGCCCCTATCGGACACAATAGGGAAAGCTATATGGTCCCCTTTATCCCTCTGTAT
``` gp100 #24
```
  E  P  S  G  T  T  S  V  Q  V  P  T  T  K  V  I  S  T  A  P  V  Q  M  P  T  A  E  S  T  G
GAGCCTAGCGGAACCACAAGCGTCCAGGTCCCCACAACCGAAGTGATTAGCACAGCCCCTGTGCAAATGCCTACCGCTGAGTCCACCGGA
```

TRP2 #11
```
  K  K  R  V  H  P  D  Y  V  I  T  T  Q  H  W  L  G  L  L  G  P  N  G  T  Q  P  Q  F  A  N
AAGAAAAGGGTCCACCCTGACTATGTGATTACCACACAGCATTGGCTCGGCCTCCTGGGACCCAATGGCACACAGCCTCAGTTTGCCAAT
``` gp100 #38
```
  L  H  Q  I  L  K  G  G  S  G  T  Y  C  L  N  V  S  L  A  D  T  N  S  L  A  V  V  S  T  Q
CTGCATCAGATTCTGAAAGGCGGAAGCGGAACCTATTGCCTCAACGTCAGCCTCGCCGATACCAATAGCCTCGCCGTCGTGTCCACCCAA
``` gp100 #30
```
  P  E  P  E  G  P  D  A  S  S  I  M  S  T  E  S  I  T  G  S  L  G  P  L  L  D  G  T  A  T
CCCGAACCCGAAGGCCCTGACGCTAGCTCCATCATGAGCACAGAGTCCATCACAGGCTCCCTGGGACCCCTCCTGGATGGCACAGCCACA
``` gp100 #31
```
  S  I  T  G  S  L  G  P  L  L  D  G  T  A  T  L  R  L  V  K  R  Q  V  P  L  D  C  V  L  Y
AGCATTACCGGAAGCCTCGGCCCTCTGCTCGACGGAACCGCTACCCTCAGGCTCGTGAAAAGGCAAGTGCCTCTGGATTGCGTCCTGTAT
``` gp100 #5
```
  D  C  W  R  G  G  Q  V  S  L  K  V  S  N  D  G  P  T  L  I  G  A  N  A  S  F  S  I  A  L
GACTGTTGGAGAGGCGGACAGGTCAGCCTCAAGGTCAGCAATGACGGACCCACACTGATTGGCGCTAACGCTAGCTTTAGCATTGCCCTC
```

Synthetic Protein:
-----------------
```
WNRQLYPEWTEAQRLDCWRGGQVSLKVSNDPYILRNQDDRELWPRKFFHRTCKCTGNFAGRNGDFFISSKDLGYDYSYLQDSDPDSFQDYAAPAFLTW
HRYHLLRLEKDMQEMLQEPSFSGHNRESYMVPFIPLYRNGDFFISSKDLGYDLLCLERDLQRLIGNESFALPYWNFATGRNETTEVVGTTPGQAPTAE
PSGTTSVQVPTTEVSTDYYQELQRDISEMFLQIYKQGGFLGLSNACMEISSPGCQPPAQRLCQPVLPSPACQLVDQLGYSYAIDLPVSVEETPGWPTT
LLVVMGTEDGPIRRNPAGNVARPMVQRLPEPQDVAQCMTVDSLVNKECCPRLGAESANVCGSQQGRNQYKTEAASRYNLTISDVSVSDVPFPFSAQAA
MSPLWWGFLLSCLGCKILPGAQGQFFRVADLSYTWDFGDSSGTLISRALVVTHTYLEPLAEMSTPEATGMTPAEVSIVVLSGTTAAQVIKFRPGSVVV
QLTLAFREGTINVHDVETQFGSAATWGQDVTSVPVTRPALGSTTPPAHDVLHKRQRPVHQGFGLKGAVTLTILLGIFFLCLALIICNAIIDPLIYAFH
SQELRRTLKEVLKFFHRTCKCTGNFAGYNCGDCKFGWTGPNCLSLQKFDNPPFFQNSTFSFRNALEGFDKADSKSTPFSIPSHHSDTPTTLASHSTKT
DASSAANRPALGSTAPPVHNVTSASGSASGSASTCNGTYEGLLRRNQMGRNSMKLPTLKDIRDCTHHSSVPPLTSSNHSTSPQLSTGVSFFFLSFIAY
```

Figure 27 (Cont)

YDHVAVLLCLVVFFLAMLVLMAVLYVKLTGDENFTIPYWDWRDAEKCDICTDEYMGLRLVKRQVPLDCVLYRYGSFSVTLDIVQGIFLQIYKQGGFLG
LSNIKFRPGSVVVQLTLAVIDVITCSSMLSSLCFLGAIAVDRYISIFYRNPGNHDKSRTPRLPSSADVEFCLSLTQYEFDEWLRRYNADISTFPLENA
PIGHNRQYNMVSLADTNSLAVVSTQLIMPGQEAGLGQVPLGPVTAQVVLQAAIPLTSCGSSPVPGTTDGHKFGFWGPNCTERRLLVRRNIFDLSAPEK
DKLGTHTMEVTVYHRRGSRSYVPLAHSSSAFTAVAAIWVASVVFSTLFIAYYDHVAVLLCLVGTLDSQVMSLHNLVHSFLNGTNALPHSAANGCWYCR
RRNGYRALMDKSLHVGTQCALTRRPWHRLFLLRWEQEIQKLTGDENFTIPYWDWAAMAVQGSQRRLLGSLNSTPTAIPQLGLAAVVATIAKNRNLHSP
MYCFICCLALSDLLVSQSSMHNALHIYMNGTMSQVQGSANDPIFLLGQHPTNPNLLSPASFFSSWQIVCSRLEEYNYCFICCLALSDLLVSGTNVLET
AVILLLEADPTLISRNSRFSSWETVCDSLDDYNHLVTLTRPALGSTTPPAHDVTSAPDNKAARDAEKCDICTDEYMGGQHPTNPMLLSPASFTFALQL
HDPSGYLAEADLSYTWDFGDSSGTSSADVEFCLSLTQYESGSMDKAANFSFRNTGPTLIGANASFSIALNFPGSQKVLPDGQVIWGPFFLHLTLIVLC
PEHPTCGCIFKNFNLFCQCSGNFMGFNCGNCKFGFWGPNCTERRLLQYRRLRKGYTPLMETHLSSKRYTEEAAAPLENAPIGHNRQYNMVPFWPPVTN
TEMFVTNFPGSQKVLPDGQVIWVNNTIINGSQVWGGRPTAEAPNTTAGQVPTTEVVGTTPGQAPTASTPGGEKETSATQRSSVPSSTEKNAVSMTSLI
YRRRLMKQDFSVPQLPHSSSHWLRLPRILGLLGPNGTQPQFANCSVYDFFVWLHYYSVCLEVGLFDTPPFYSNSTNSFRNTVEGYSDPAAMDLVLKRC
LLHHLAVIGALLAVGATKVPRNQTGARCLEVSISDGLFLSLGLVSLVENALSGSMDKAANFSFRNTLEGFASPLTGIADASSPCGQLSGRGSCQNILLS
NAPLGPQFPFTGMHYYVSMDALLGGSEIWRDIDFAHEAPAFLEEKQPLLMEKEDYHSLYQSHLAAGQCTEVRADTRPWSGPYILRNQDDRELWPRSVP
SSTEKNAVSMTSSVLSSHSPGSGSSTTTPMFNDINIYDLFVWMHYYVSMDALLGGSEQPVYPQETDDACIFPDGGPCPSGSWSQKRSDSLEDYDTLGT
LCNSTEDGPIRRNPAGNVAWVNNTIINGSQVWGGQPVYPQETDDACIFPQEKNCEPVVPNAPPAYEKLSAEQSPPPYSPSRSYVPLAHSSSAFTITDQ
VPFSVSVSQLRLEKDMQEMLQEPSFSLPYWNFATGKNVCDIVPFWPPVTNTEMFVTAPDNLGYTYEAACSVYDFFVWLHYYSVRDTLLGPGRPYRAID
VRRNIFDLSAPEKDKFFAYLTLAKHTISSDKKGHGHSYTTAEEAAGIGILTVILGVLLLIFVVVWKTWGQYWQVLGGPVSGLSIGTGRAMGGPVSGLS
IGTGRAMLGTHTMEVTVYHRRGISTAPVQMPTAESTGMTPEKVPVSEVMGTTFSSWQIVCSRLEEYNSHQSLCNGTPEGPLRDPIFVVLHSFTDAIFD
EWMKRFNPPADAWPHMLARACQHAQGIARLHKRQRPVHQGFGLKLLTVLTVVTGSGHASSTPGGEKETSATQRSFCSCPIGENSPLLSGQQVAATFSF
RNALEGFDKADGTLDSQVMSLHNLVHSHQSLCNGTPEGPLRRNPGNHDKSRTPRLPPFFPPVTNEELFLTSDQLGYSYAIDLPVSVERKKPPVIRQNI
HSLSPQEREQFLGALDLAQELAPIGHNRMYNMVPFFPPVTNEELFLTSEVSIVVLSGTTAAQVTTTEWVETTARELPITSPQLSTGVSFFFLSFHISN
LQFNSSLEDPYHTHGRYVPPSSTDRSPYEKVSAGNGGSSLLFLSLGLVSLVENALVVATIAKNRNLHSPMSFLNGTNALPHSAANDPIFVVLHSFTDA
IPAVCQCRRKNYGQLDIFPARDTYHPMSEYPTVFFLAMLVLMAVLYVHMLARACQHAQGIARSTNSFRNTVEGYSDPTGKYDPAVRSLHNLALPYWNF
ATGKNVCDICTDDLMGSRSNFDSTIITDQVPFSVSVSQLRALDGGNKHFLRNQPLFHISNLQFNSSLEDPSTDYYQELQRDISEMSPYEKVSAGNGGSS
LSYTNPAVAAASANLAYVIPIGTYGQMKNGSTPMFNDINIYDLFVWRLCQPVLPSPACQLVLHQILKGGSGTYCLNRYGSFSVTLDIVQGIESAEILQ
AVPSGEGDHHAFVDSIFEQWLQRHRPLQEVYPEANAPICTDDLMGSRSNFDSTLISPNSVFSQWRVVCFPARDTYHPMSEYPTYTHGRYVPPSSTDR
SYTNPAVAAASANLAAEHPTCGCIFKNFNLPIALIICNAIIDPLIYMSQVQGSANDPIFLLHHAFVDSIFEQWLQRRNSMKLPTLKDIRDCLSLQKFD
NPPFFQNSLISRALVVTHTYLEPGPVTAQVVLQAAIPLSFALPYWNFATGRNECDVCTDQLFGAARPDDPTLISRNSRFSSWEAAMPREDAHFIYGYPKKGHGHSYTTAEEAATGKYDPAV
RSLHNLAHLFLNGTGGQTHLSSSDVSVSDVPFPFSAQSGAGVPGWGIALLVLSPQEREQFLGALDLAKKRVHPDYVITTQHWFFAYLTLAKHTISSDY
VIPIGTYGQMKNGSGTNVLETAVILLLEAGALVARAAVLQQLDNVCVLVALAIVYLIALAVCQCRRKNYGQLDICPQEGFDHRDSKVSLQEKNCEPVV
PNAPPASVLSSHSPGSGSSTTQGQDVTLAPATEPASDEWMKRFNPPADAWPQELAPIGHNRMYNMVAFHSQELRRTLKEVLTCSWAAPFSHQGPAFVTW
HRYHLLCLERDLQRLIGNERPMVQRLPEPQDVAQCLEVGLFDTPPFYSNQDPIFVLLHTFTDAVFDEWLRRYNADISTFLGAESANVCGSQQGRGQCT
EVRADTRPWSGYNCGDCKFGWTGPNCERKKPPVIRQNIHSLHLFLNGTGGQTHLSSQDPIFVLLHTFTDAVGLVSLLCRHKRKQLPEEKQPLLMEKED
YHSGCKILPGAQGQFPRVCMTVDSLVNKECCPRQLPHSSSHWLRLPRIFCSCPIGENSPLLSGDGGPCPSGSWSQKRSFVYVWKTWGQYWQVLNQDWL
GVSRQLRTKAWNRQLYPEWTEAQRLIWRDIDFAHEAPAFLPWHRLFLLRWEQEIQAAMTPGTQSPFFLLLLLTVLTVVTGSGHASDKSLHVGTQCALT
RRCPQEGFDHRDSKVSLNVTSASGSASGSASTLVHNGTSARATTTPALEGFASPLTGIADASQSSMHNALHIYMNGTRDTLLGPGRPYRAIDFSHQGP
AFVTWHRYHAAMLLAVLYCLLWSPQTSAGHFPRACVSSKAFELTVSCQGGLPKEACMEISSPGCQPPAQVDDRESWPSVFYNRTCQCSGNFMGFNCGN
CESABILQAVPSGEGDAFELTVSCQGGLPKETVCDSLDDYNHLVTLCNGTYEGLLRRNQMGLLSNAPLGPQFPPTGVDDRESWPSVFYNRTYEKLSAE
QSPPPYSPAAIVGILLVLMAVVLASLIYRRRLMKQDFSVPGIGILTVILGVLLLIGCWYCRRRNGYRALMYSYLQDSDPDSFQDYIKSYLEQASRIWS
WLQGQDVTLAPATEPASGSAATWGQDVTSVPVTSCGSSPVPGTTDGHRPTAEAPNTTAGQVPLVHNGTSARATTTPASKSTPFSIPSHHSDTEETPGW
PTTLLVVMGTLVALVGLFVLLAFLTTTEWVETTARELPIPEPEGPDASSIMSTEGAVTLTILLGIFFLCWGPFFLHLTLIVLCPLGAAMVGAVLTALL
AGLVSLLCRHKRKQLPGALVARAAVLQQLDNVIDVITCSSMLSSLCMTPEKVPVSEVMGTTLAEMSTPEATGMTPAQTSAGHFPRACVSSKNLMEKEC
CPPWSGDRALRYHSIVTLPRAPRAVAAIWVASVVFSTLFREGTINVHDVETQFNQYKTEAASRYNLTINLMBEKECCPPWSGDRSPCGQLSGRGSCQNI
IKSYLEQASRIWSWLLGAAMVGAVLTALLAPTTLASHSTKTDASSTHHSSVPPLTSSNHSSGAGVPGWGIALLVLVCVLVALAIVYLIALFLGAIAVD
RYISIFYALRYHSIVTLPRAPRLIMPGQEAGLGQVPLIVGILLVLMAVVLASTLVALVGLFVLLAFLQYRRLRKGYTPLMETLISPNSVFSQWRVVCD
SLEDYDTLGTLCNSLNSTPTAIPQLGLAANQTGARCLEVSISDGHRPLQEVYPEANAPIGHNRESYMVPFIPLYEPSGTTSVQVPTTEVISTAPVQMP
TAESTGKKRVHPDYVITTQHWLGLLGPNGTQPQFANLHQILKGGSGTYCLNVSLADTNSLAVVSTQPEPEGPDASSIMSTESITGSLGPLLDGTATSI
TGSLGPLLDGTATLRLVKRQVPLDCVLYDCWRGGQVSLKVSNDGPTLIGANASFSIAL

Synthetic DNA:
----------------

TGGAATAGGCAACTGTATCCCGAATGGACAGAGGCTCAGAGACTGGATTGCTGGAGGGGAGGCCAAGTGTCCCTGAAAGTGTCCAACGATCCCTATAT
CCTCAGGAATCAGGATGACAGAGAGCTCTGGCCTAGGAAATTCTTTCACAGAACCTGTAAGTGTACCGGAAACTTTGCCGGAAGGAATGGCGATTTCT
TTATCTCCAGCAAAGACCTCCGCTATGACTATAGCTATCTGCAAGACTCCGACCCTGACTCCTTCCAAGACTATGCCGCTCCCGCTTTCCTCACCTGG
CACAGATACCATCTGCTCAGGCTCGAGAAAGACATGCAGGAAATGCTCCAGGAACCCTCCTTCTCCGGCCATAACAGAGAGTCCTACATGGTGCCTTT
CATTCCCCTCTACAGAAACGGAGACTTTTTCATTAGCTCCAAGGATCTGGATACGATCTGCTCTGCCTCGAGAGAGACCTCCAGAGACTGATTGGCA
ATGAGTCCTTCGCTCTGCCTTACTGGACAGGCAGGACAGAAACGAAACCACAGAGGTCGTGGGAACCACACCCGGACAGGCTCCCACAGCCGGA
CCCTCCGGCACAACCTCCGTGCAAGTGCCTACCACAGAGGTCAGCACAGATATTACCAAGAGCTCCAGAGAGACATTAGCGAAATGTTTCTGCAAAT
CTATAAGCAAGGCGGATTCCTCGGCCTCAGCAATGCCTGTATGGAAATCTCCAGCCCTGGCTGTCAGCCTCCCGCTCAGAGACTGTGTCAGCCTGTGC
TCCCCTCCCCCGCTTGCCAACTGGTCGACCAACTGGGATACTCCTACGCTATCGATCTGCCTGTGTCCGTGGAGAGACACCCGGATGGCTACCACA
CTGCTCGTGGTCATGGGAACCGAAGACGGACCCATTAGGAGAAACCCTGCCGGAAACCTCGCCAGACCCATGGTGCAAAGGCTCCCGAACCCCAAGA
CGTCGCCCAATGCATGACCGTCGACTCCCTGGTCAACAAAGAGTGTTGCCCTAGGCTCGGCGCTCGAGTCCGCCAATGTGTGTGGCTCCCAGCAAGGCA
GAAACCAATACAAAACCGAAGCCGCTAGCAGATACAATCTGACAATCTCCGACGTCAGCGTCAGCGATGTGCCTTTCCCTTTCTCCGCCCAAGCCGCT
ATGGTCCCCCCTCTGGTGGGGCTTTCTGCTCAGCTGTCTGGGATGCAAAATCCTCCCCAGGACCCAAGGCCAATTCCCTAGGGTCGCCGATCTGTCCTA
CACATGGGATTTCGGAGACTCCAGCGGAACCCTCATCTCCAGGGCTCTGGTCGTGACACACATACCTCGAGCCTCTGGCTGAGATGAGCACACCCG
AAGCCACAGGCATGACCCCTGCCGAAGTGTCCATCGTCGTGCTCAGCGAACCACAGCCGCTCAGGTCATCAAATTCAGACCCGGAAGCGTCGTGGTC
CAGCTCACCCTCGCCTTTAGGGAAGGCACAATCAATGTGCATGACGTCGAGACACAGTTTGGCTCCGCCGCTACCTGGGGCCAAGACGTCACCTCCGT
GCCCTGTGACAAGGCCTGCCCCTCGGCCTCCACCACACCCCCTGCCCATGACGTCCTGACTAAGAGACAGAGACCCGTCCACCAAGGCTTTGGCCTCAAGG
GAGCCGTCACCCTCACCATTCTGCTCGGCATTTTCTTTCTGGTGTCTGGCTCTGATTATCTGTAACGCTATCATTGACCCTCTGATTTACGCTTTCCAT
AGCCAAGAGCTCAGGAGAACCCTCAAGGAAGTGCTCAAGGTTTTTCCATAGGACATGCAAATGCACAGGCAATTTCGCTGGCTATAACTGTGGCGATTG
CAAATTCGGATGGACAGGCCCTAACTGTCTGTCCCTGCAAAAGTTTGACAATCCCCCTTTCTTTCAGAATAGCACATTCTCCTTCAGAAACGCTCTGG

```
ATATGGTCCCCTTTATCCCTCTGTATGAGCCTAGCGGAACCACAAGCGTCCAGGTCCCCACAACCGAAGTGATTAGCACAGCCCCTGTGCAAATGCCT
ACCGCTGAGTCCACCGGAAAGAAAAGGGTCCACCCTGACTATGTGATTACCACACAGCATTGGCTCGGCCTCCTGGGACCCAATGGCACACAGCCTCA
GTTTGCCAATCTGCATCAGATTCTGAAAGGCGGAAGCGGAACCTATTGCCTCAACGTCAGCCTCGCCGATACCAATAGCCTCGCCGTCGTGTCCACCC
AACCCGAACCCGAAGGCCCTGACGCTAGCTCCATCATGAGCACAGAGTCCATCACAGGCTCCCTGGGACCCCTCCTGGATGGCACAGCCACAAGCATT
ACCGGAAGCCTCGGCCCTCTGCTCGACGGAACCGCTACCCTCAGGCTCGTGAAAAGGCAAGTGCCTCTGGATTGCGTCCTGTATGACTGTTGGAGAGG
CGGACAGGTCAGCCTCAAGGTCAGCAATGACGGACCCACACTGATTGGCGCTAACGCTAGCTTTAGCATTGCCCTC

Melanoma cancer Specific Savine Scramble process

Scramble - Output File

Scramble version  : 0.1 beta, 08/02/1999
Num. genes        : 10
Num. segments     : 121
Segment length    : 30
Segment overlap   : 15

Segments in original order:
---------------------------
Gene       : BAGE
Segment#   : 1
Offset     : 1
1st Codon  : 1
   A  A  M  A  A  R  A  V  F  L  A  L  S  A  Q  L  L  Q  A  R  L  M  K  E  E  S  P  V  V  S
GCCGCTATGGCTGCCAGAGCCGTCTTCCTCGCCCTCAGCGCTCAGCTCCTGCAAGCCAGACTGATGAAGGAAGAGTCCCCCGTCGTGTCC Gene       : BAGE
Segment#   : 2
Offset     : 16
1st Codon  : 1
   L  L  Q  A  R  L  M  K  E  E  S  P  V  V  S  W  R  L  E  P  E  D  G  T  A  L  C  F  I  F
CTGCTCCAGGCTAGGCTCATGAAAGAGGAAAGCCCTGTGGTCAGCTGGAGGCTCGAGCCTGAGGATGGCACAGCCCTCTGCTTTATCTTT Gene       : BAGE
Segment#   : 3
Offset     : 31
1st Codon  : 1
   W  R  L  E  P  E  D  G  T  A  L  C  F  I  F  A  A
TGGAGACTGGAACCCGAAGACGGAACCGCTCTGTGTTTCATTTTCGCTGCC Gene       : GAGE-1
Segment#   : 1
Offset     : 1
1st Codon  : 1
   A  A  M  S  W  R  G  R  S  T  Y  R  P  R  P  R  R  Y  V  E  P  P  E  M  I  G  P  M  R  P
GCCGCTATGTCCTGGAGAGGCAGAAGCACATACAGACCCAGACCCAGAAGGTATGTGGAACCCCCTGAGATGATCGGACCCATGAGGCCT Gene       : GAGE-1
Segment#   : 2
Offset     : 16
1st Codon  : 1
   R  R  Y  V  E  P  P  E  M  I  G  P  M  R  P  E  Q  F  S  D  E  V  E  P  A  T  P  E  E  G
AGGAGATACGTCGAGCCTCCCGAAATGATTGGCCCTATGAGACCCGAACAGTTTAGCGATGAGGTCGAGCCTGCCACACCCGAAGAGGGA Gene       : GAGE-1
Segment#   : 3
Offset     : 31
1st Codon  : 1
   E  Q  F  S  D  E  V  E  P  A  T  P  E  E  G  E  P  A  T  Q  R  Q  D  P  A  A  A  Q  E  G
GAGCAATTCTCCGACGAAGTGGAACCCGCTACCCCTGAGGAAGGCGAACCCGCTACCCAAAGGCAAGACCCTGCCGCTGCCCAAGAGGGA Gene       : GAGE-1
Segment#   : 4
Offset     : 46
1st Codon  : 1
   E  P  A  T  Q  R  Q  D  P  A  A  A  Q  E  G  E  D  E  G  A  S  A  G  Q  G  P  K  P  E  A
GAGCCTGCCACACAGAGACAGGATCCCGCTGCCGCTCAGGAAGGCGAAGACGAAGGCGCTAGCGCTGGCCAAGGCCCTAAGCCTGAGGCT Gene       : GAGE-1
Segment#   : 5
Offset     : 61
1st Codon  : 1
```

Figure 27 (Cont)

```
              E  D  E  G  A  S  A  G  Q  G  P  K  P  E  A  D  S  Q  E  Q  G  H  P  Q  T  G  C  E  C  E
GAGGATGAGGGAGCCTCCGCCGGACAGGGACCCAAACCCGAAGCCGATAGCCAAGAGCAAGGCCATCCCCAAACCGGATGCGAATGCGAA

Gene     : GAGE-1
Segment# : 6
Offset   : 76
1st Codon : 1
           D  S  Q  E  Q  G  H  P  Q  T  G  C  E  C  E  D  G  P  D  G  Q  E  M  D  P  P  N  P  E  E
GACTCCCAGGAACAGGGACACCCTCAGACAGGCTGTGAGTGTGAGGATGGCCCTGACGGACAGGAAATGGATCCCCCTAACCCTGAGGAA Gene     : GAGE-1
Segment# : 7
Offset   : 91
1st Codon : 1
           D  G  P  D  G  Q  E  M  D  P  P  N  P  E  E  V  K  T  P  E  E  E  M  R  S  H  Y  V  A  Q
GACGGACCCGATGGCCAAGAGATGGACCCTCCCAATCCCGAAGAGGTCAAGACACCCGAAGAGGAAATGAGAAGCCATTACGTCGCCCAA Gene     : GAGE-1
Segment# : 8
Offset   : 106
1st Codon : 1
           V  K  T  P  E  E  E  M  R  S  H  Y  V  A  Q  T  G  I  L  W  L  L  M  N  N  C  F  L  N  L
GTGAAAACCCCTGAGGAAGAGATGAGGTCCCACTATGTGGCTCAGACAGGCATTCTGTGGCTGCTCATGAATAACTGTTTCCTCAACCTC Gene     : GAGE-1
Segment# : 9
Offset   : 121
1st Codon : 1
           T  G  I  L  W  L  L  M  N  N  C  F  L  N  L  S  P  R  K  P  A  A
ACCGGAATCCTCTGGCTCCTGATGAACAATTGCTTTCTGAATCTGTCCCCCAGAAAGCCTGCCGCT Gene     : gp100In4
Segment# : 1
Offset   : 1
1st Codon : 1
           A  A  S  W  S  Q  K  R  S  F  V  Y  V  W  K  T  W  G  E  G  L  P  S  Q  P  I  I  H  T  C
GCCGCTAGCTGGAGCCAAAAGAGAAGCTTTGTGTATGTGTGGAAGACATGGGGAGAGGGACTGCCTAGCCAACCCATTATCCATACCTGT Gene     : gp100In4
Segment# : 2
Offset   : 16
1st Codon : 1
           T  W  G  E  G  L  P  S  Q  P  I  I  H  T  C  V  Y  F  F  L  P  D  H  L  S  F  G  R  P  F
ACCTGGGGCGAAGGCCTCCCCTCCCAGCCTATCATTCACACATGCGTCTACTTTTTCCTCCCCGATCACCTCAGCTTTGGCAGACCCTTT Gene     : gp100In4
Segment# : 3
Offset   : 31
1st Codon : 1
           V  Y  F  F  L  P  D  H  L  S  F  G  R  P  F  H  L  N  F  C  D  F  L  A  A
GTGTATTTCTTTCTGCCTGACCATCTGTCCTTCGGAAGGCCTTTCCATCTGAATTTCTGTGACTTTCTGGCTGCC Gene     : MAGE-1
Segment# : 1
Offset   : 1
1st Codon : 1
           A  A  M  S  L  E  Q  R  S  L  H  C  K  P  E  E  A  L  E  A  Q  Q  E  A  L  G  L  V  C  V
GCCGCTATGTCCCTGGAACAGAGAAGCCTCCACTGTAAGCCTGAGGAAGCCCTCGAGGCTCAGCAAGAGGCTCTGGGACTGGTCTGCGTC Gene     : MAGE-1
Segment# : 2
Offset   : 16
1st Codon : 1
           E  A  L  E  A  Q  Q  E  A  L  G  L  V  C  V  Q  A  A  T  S  S  S  S  P  L  V  L  G  T  L
GAGGCTCTGGAAGCCCAACAGGAAGCCCTCGGCCTCGTGTGTGTGCAAGCCGCTACCTCCAGCTCCAGCCCTCTGGTCCTGGGAACCCTC Gene     : MAGE-1
Segment# : 3
Offset   : 31
1st Codon : 1
           Q  A  A  T  S  S  S  S  P  L  V  L  G  T  L  E  E  V  P  T  A  G  S  T  D  P  P  Q  S  P
CAGGCTGCCACAAGCTCCAGCTCCCCCCTCGTGCTCGGCACACTGGAAGAGGTCCCCACAGCCGGAAGCACAGACCCTCCCCAAAGCCCT
```

Figure 27 (Cont)

```
Gene      : MAGE-1
Segment#  : 4
Offset    : 46
1st Codon : 1
  E   E   V   P   T   A   G   S   T   D   P   P   Q   S   P   Q   G   A   S   A   F   P   T   T   I   N   F   T   R   Q
GAGGAAGTGCCTACCGCTGGCTCCACCGATCCCCCTCAGTCCCCCCAAGGCGCTAGCGCTTTCCCTACCACAATCAATTTCACAAGGCAA Gene      : MAGE-1
Segment#  : 5
Offset    : 61
1st Codon : 1
  Q   G   A   S   A   F   P   T   T   I   N   F   T   R   Q   R   Q   P   S   E   G   S   S   S   R   E   E   E   G   P
CAGGGAGCCTCCGCCTTTCCCACAACCATTAACTTTACCAGACAGAGACAGCCTAGCGAAGGCTCCAGCTCCAGGGAAGAGGAAGGCCCT Gene      : MAGE-1
Segment#  : 6
Offset    : 76
1st Codon : 1
  R   Q   P   S   E   G   S   S   S   R   E   E   E   G   P   S   T   S   C   I   L   E   S   L   F   R   A   V   I   T
AGGCAACCCTCCGAGGGAAGCTCCAGCAGAGAGGAAGAGGGACCCTCCACCTCCTGCATTCTGGAAAGCCTCTTCAGAGCCGTCATCACA Gene      : MAGE-1
Segment#  : 7
Offset    : 91
1st Codon : 1
  S   T   S   C   I   L   E   S   L   F   R   A   V   I   T   K   K   V   A   D   L   V   G   F   L   L   L   K   Y   R
AGCACAAGCTGTATCCTCGAGTCCCTGTTTAGGGCTGTGATTACCAAAAAGGTCGCCGATCTGGTCGGCTTTCTGCTCCTGAAATACAGA Gene      : MAGE-1
Segment#  : 8
Offset    : 106
1st Codon : 1
  K   K   V   A   D   L   V   G   F   L   L   L   K   Y   R   A   R   E   P   V   T   K   A   E   M   L   E   S   V   I
AAGAAAGTGGCTGACCTCGTGGGATTCCTCCTGCTCAAGTATAGGGCTAGGGAACCCGTCACCAAAGCCGAAATGCTCGAGTCCGTGATT Gene      : MAGE-1
Segment#  : 9
Offset    : 121
1st Codon : 1
  A   R   E   P   V   T   K   A   E   M   L   E   S   V   I   K   N   Y   K   H   C   F   P   E   I   F   G   K   A   S
GCCAGAGAGCCTGTGACAAAGGCTGAGATGCTGGAAAGCGTCATCAAAAACTATAAGCATTGCTTTCCCGAAATCTTTGGCAAAGCCTCC Gene      : MAGE-1
Segment#  : 10
Offset    : 136
1st Codon : 1
  K   N   Y   K   H   C   F   P   E   I   F   G   K   A   S   E   S   L   Q   L   V   F   G   I   D   V   K   E   A   D
AAGAATTACAAACACTGTTTCCCTGAGATTTTCGGAAAGGCTAGCGAAAGCCTCCAGCTCGTGTTTGGCATTGACGTCAAGGAAGCCGAT Gene      : MAGE-1
Segment#  : 11
Offset    : 151
1st Codon : 1
  E   S   L   Q   L   V   F   G   I   D   V   K   E   A   D   P   T   G   H   S   Y   V   L   V   T   C   L   G   L   S
GAGTCCCTGCAACTGGTCTTCGGAATCGATGTGAAAGAGGCTGACCCTACCGGACACTCCTACGTCCTGGTCACCTGTCTGGGACTGTCC Gene      : MAGE-1
Segment#  : 12
Offset    : 166
1st Codon : 1
  P   T   G   H   S   Y   V   L   V   T   C   L   G   L   S   Y   D   G   L   L   G   D   N   Q   I   M   P   K   T   G
CCCACAGGCCATAGCTATGTGCTCGTGACATGCCTCGGCCTCAGCTATGACGGACTGCTCGGCGATAACCAAATCATGCCCAAAACCGGA Gene      : MAGE-1
Segment#  : 13
Offset    : 181
1st Codon : 1
  Y   D   G   L   L   G   D   N   Q   I   M   P   K   T   G   F   L   I   I   V   L   V   M   I   A   M   E   G   G   H
TACGATGGCCTCCTGGGAGACAATCAGATTATGCCTAAGACAGGCTTTCTGATTATCGTCCTGGTCATGATTGCCATGGAGGGAGGCCAT Gene      : MAGE-1
```

Figure 27 (Cont)

```
Segment#   : 14
Offset     : 196
1st Codon  : 1
 F  L  I  I  V  L  V  M  I  A  M  E  G  G  H  A  P  E  E  E  I  W  E  E  L  S  V  M  E  V
TTCCTCATCATTGTGCTCGTGATGATCGCTATGGAAGGCGGACACGCTCCCGAAGAGGAAATCTGGGAGGAACTGTCCGTGATGGAGGTC Gene       : MAGE-1
Segment#   : 15
Offset     : 211
1st Codon  : 1
 A  P  E  E  E  I  W  E  E  L  S  V  M  E  V  Y  D  G  R  E  H  S  A  Y  G  E  P  R  K  L
GCCCCTGAGGAAGAGATTTGGGAAGAGCTCAGCGTCATGGAAGTGTATGACGGAAGGGAACACTCCGCCTATGGCGAACCCAGAAAGCTC Gene       : MAGE-1
Segment#   : 16
Offset     : 226
1st Codon  : 1
 Y  D  G  R  E  H  S  A  Y  G  E  P  R  K  L  L  T  Q  D  L  V  Q  E  K  Y  L  E  Y  R  Q
TACGATGGCAGAGAGCATAGCGCTTACGGAGAGCCTAGGAAACTGCTCACCCAAGACCTCGTGCAAGAGAAATACCTCGAGTATAGGCAA Gene       : MAGE-1
Segment#   : 17
Offset     : 241
1st Codon  : 1
 L  T  Q  D  L  V  Q  E  K  Y  L  E  Y  R  Q  V  P  D  S  D  P  A  R  Y  E  F  L  W  G  P
CTGACACAGGATCTGGTCCAGGAAAAGTATCTGGAATACAGACAGGTCCCCGATAGCGATCCCGCTAGGTATGAGTTTCTGTGGGGCCCT Gene       : MAGE-1
Segment#   : 18
Offset     : 256
1st Codon  : 1
 V  P  D  S  D  P  A  R  Y  E  F  L  W  G  P  R  A  L  A  E  T  S  Y  V  K  V  L  E  Y  V
GTGCCTGACTCCGACCCTGCCAGATACGAATTCCTCTGGGGACCCAGAGCCCTCGCCGAAACCTCCTACGTCAAGGTCCTGGAATACGTC Gene       : MAGE-1
Segment#   : 19
Offset     : 271
1st Codon  : 1
 R  A  L  A  E  T  S  Y  V  K  V  L  E  Y  V  I  K  V  S  A  R  V  R  F  F  F  P  S  L  R
AGGGCTCTGGCTGAGACAAGCTATGTGAAAGTGCTCGAGTATGTGATTAAGGTCAGCGCTAGGGTCAGGTTTTTCTTTCCCTCCCTGAGA Gene       : MAGE-1
Segment#   : 20
Offset     : 286
1st Codon  : 1
 I  K  V  S  A  R  V  R  F  F  F  P  S  L  R  E  A  A  L  R  E  E  E  E  G  V  A  A
ATCAAAGTGTCCGCCAGAGTGAGATTCTTTTTCCCTAGCCTCAGGGAAGCCGCTCTGAGAGAGGAAGAGGAAGGCGTCGCCGCT Gene       : MAGE-3
Segment#   : 1
Offset     : 1
1st Codon  : 1
 A  A  M  P  L  E  Q  R  S  Q  H  C  K  P  E  E  G  L  E  A  R  G  E  A  L  G  L  V  G  A
GCCGCTATGCCTCTGGAACAGAGAAGCCAACACTGTAAGCCTGAGGAAGGCCTCGAGGCTAGGGGAGAGGCTCTGGGACTGGTCGGCGCT Gene       : MAGE-3
Segment#   : 2
Offset     : 16
1st Codon  : 1
 E  G  L  E  A  R  G  E  A  L  G  L  V  G  A  Q  A  P  A  T  E  E  Q  E  A  A  S  S  S
GAGGGACTGGAAGCCAGAGGCGAAGCCCTCGGCCTCGTGGGAGCCCAAGCCCCTGCCACAGAGGAACAGGAAGCCGCTAGCTCCAGCTCC Gene       : MAGE-3
Segment#   : 3
Offset     : 31
1st Codon  : 1
 Q  A  P  A  T  E  E  Q  E  A  A  S  S  S  S  T  L  V  E  V  T  L  G  E  V  P  A  A  E  S
CAGGCTCCCGCTACCGAAGAGCAAGAGGCTGCCTCCAGCTCCAGCACACTGGTCGAGGTCACCCTCGGCGAAGTGCCTGCCGCTGAGTCC Gene       : MAGE-3
Segment#   : 4
Offset     : 46
```

Figure 27 (Cont)

```
1st Codon : 1
  T  L  V  E  V  T  L  G  E  V  P  A  A  E  S  P  D  P  P  Q  S  P  Q  G  A  S  S  L  P  T
ACCCTCGTGGAAGTGACACTGGGAGAGGTCCCCGCTGCCGAAAGCCCTGACCCTCCCCAAAGCCCTCAGGGAGCCTCCAGCCTCCCCACA Gene      : MAGE-3
Segment#  : 5
Offset    : 61
1st Codon : 1
  P  D  P  P  Q  S  P  Q  G  A  S  S  L  P  T  T  M  N  Y  P  L  W  S  Q  S  Y  E  D  S  S
CCCGATCCCCCTCAGTCCCCCCAAGGCGCTAGCTCCCTGCCTACCACAATGAATTACCCTCTGTGGAGCCAAAGCTATGAGGATAGCTCC Gene      : MAGE-3
Segment#  : 6
Offset    : 76
1st Codon : 1
  T  M  N  Y  P  L  W  S  Q  S  Y  E  D  S  S  N  Q  E  E  E  G  P  S  T  F  P  D  L  E  S
ACCATGAACTATCCCCTCTGGTCCCAGTCCTACGAAGACTCCAGCAATCAGGAAGAGGAAGGCCCTAGCACATTCCCTGACCTCGAGTCC Gene      : MAGE-3
Segment#  : 7
Offset    : 91
1st Codon : 1
  N  Q  E  E  E  G  P  S  T  F  P  D  L  E  S  E  F  Q  A  A  L  S  R  K  V  A  E  L  V  H
AACCAAGAGGAAGAGGGACCCTCCACCTTTCCCGATCTGGAAAGCGAATTCCAAGCCGCTCTGTCCAGGAAAGTGGCTGAGCTCGTGCAT Gene      : MAGE-3
Segment#  : 8
Offset    : 106
1st Codon : 1
  E  F  Q  A  A  L  S  R  K  V  A  E  L  V  H  F  L  L  L  K  Y  R  A  R  E  P  V  T  K  A
GAGTTTCAGGCTGCCCTCAGCAGAAAGGTCGCCGAACTGGTCCACTTTCTGCTCCTGAAATACAGAGCCAGAGAGCCTGTGACAAAGGCT Gene      : MAGE-3
Segment#  : 9
Offset    : 121
1st Codon : 1
  F  L  L  L  K  Y  R  A  R  E  P  V  T  K  A  E  M  L  G  S  V  V  G  N  W  Q  Y  F  F  P
TTCCTCCTGCTCAAGTATAGGGCTAGGGAACCCGTCACCAAAGCCGAAATGCTCGGCTCCGTGGTCGGCAATTGGCAATACTTTTTCCCT Gene      : MAGE-3
Segment#  : 10
Offset    : 136
1st Codon : 1
  E  M  L  G  S  V  V  G  N  W  Q  Y  F  F  P  V  I  F  S  K  A  S  S  S  L  Q  L  V  F  G
GAGATGCTGGGAAGCGTCGTGGGAAACTGGCAGTATTTCTTTCCCGTCATCTTTAGCAAAGCCTCCAGCTCCCTGCAACTGGTCTTCGGA Gene      : MAGE-3
Segment#  : 11
Offset    : 151
1st Codon : 1
  V  I  F  S  K  A  S  S  S  L  Q  L  V  F  G  I  E  L  M  E  V  D  P  I  G  H  L  Y  I  F
GTGATTTTCTCCAAGGCTAGCTCCAGCCTCCAGCTCGTGTTTGGCATTGAGCTCATGGAAGTGGATCCCATTGGCCATCTGTATATCTTT Gene      : MAGE-3
Segment#  : 12
Offset    : 166
1st Codon : 1
  I  E  L  M  E  V  D  P  I  G  H  L  Y  I  F  A  T  C  L  G  L  S  Y  D  G  L  L  G  D  N
ATCGAACTGATGGAGGTCGACCCTATCGGACACCTCTACATTTTCGCTACCTGTCTGGGACTGTCCTACGATGGCCTCCTGGGAGACAAT Gene      : MAGE-3
Segment#  : 13
Offset    : 181
1st Codon : 1
  A  T  C  L  G  L  S  Y  D  G  L  L  G  D  N  Q  I  M  P  K  A  G  L  L  I  I  V  L  A  I
GCCACATGCCTCGGCCTCAGCTATGACGGACTGCTCGGCGATAACCAAATCATGCCCAAAGCCGGACTGCTCATCATTGTGCTCGCCATT Gene      : MAGE-3
Segment#  : 14
Offset    : 196
1st Codon : 1
  Q  I  M  P  K  A  G  L  L  I  I  V  L  A  I  I  A  R  E  G  D  C  A  P  E  E  K  I  W  E
```

Figure 27 (Cont)

```
CAGATTATGCCTAAGGCTGGCCTCCTGATTATCGTCCTGGCTATCATTGCCAGAGAGGGAGACTGTGCCCCTGAGGAAAAGATTTGGGAA

Gene        : MAGE-3
Segment#    : 15
Offset      : 211
1st Codon   : 1
  I  A  R  E  G  D  C  A  P  E  E  K  I  W  E  E  L  S  V  L  E  V  F  E  G  R  E  D  S  I
ATCGCTAGGGAAGGCGATTGCGCTCCCGAAGAGAAAATCTGGGAGGAACTGTCCGTGCTCGAGGTCTTCGAAGGCAGAGAGGATAGCATT Gene        : MAGE-3
Segment#    : 16
Offset      : 226
1st Codon   : 1
  E  L  S  V  L  E  V  F  E  G  R  E  D  S  I  L  G  D  P  K  K  L  L  T  Q  H  F  V  Q  E
GAGCTCAGCGTCCTGGAAGTGTTTGAGGGAAGGGAAGACTCCATCCTCGGCGATCCCAAAAAGCTCCTGACACAGCATTTCGTCCAGGAA Gene        : MAGE-3
Segment#    : 17
Offset      : 241
1st Codon   : 1
  L  G  D  P  K  K  L  L  T  Q  H  F  V  Q  E  N  Y  L  E  Y  R  Q  V  P  G  S  D  P  A  C
CTGGGAGACCCTAAGAAACTGCTCACCCAACACTTTGTGCAAGAGAATTACCTCGAGTATAGGCAAGTGCCTGGCTCCGACCCTGCCTGT Gene        : MAGE-3
Segment#    : 18
Offset      : 256
1st Codon   : 1
  N  Y  L  E  Y  R  Q  V  P  G  S  D  P  A  C  Y  E  F  L  W  G  P  R  A  L  V  E  T  S  Y
AACTATCTGGAATACAGACAGGTCCCCGGAAGCGATCCCGCTTGCTATGAGTTTCTGTGGGGCCCTAGGGCTCTGGTCGAGACAAGCTAT Gene        : MAGE-3
Segment#    : 19
Offset      : 271
1st Codon   : 1
  Y  E  F  L  W  G  P  R  A  L  V  E  T  S  Y  V  K  V  L  H  H  M  V  K  I  S  G  G  P  H
TACGAATTCCTCTGGGGACCCAGAGCCCTCGTGGAAACCTCCTACGTCAAGGTCCTGCATCACATGGTGAAAATCTCCGGCGGACCCCAT Gene        : MAGE-3
Segment#    : 20
Offset      : 286
1st Codon   : 1
  V  K  V  L  H  H  M  V  K  I  S  G  G  P  H  I  S  Y  P  P  L  H  E  W  V  L  R  E  G  E
GTGAAAGTGCTCCACCATATGGTCAAGATTAGCGGAGGCCCTCACATTAGCTATCCCCCTCTGCATGAGTGGGTGCTCAGGGAAGGCGAA Gene        : MAGE-3
Segment#    : 21
Offset      : 301
1st Codon   : 1
  I  S  Y  P  P  L  H  E  W  V  L  R  E  G  E  E  A  A
ATCTCCTACCCTCCCCTCCACGAATGGGTCCTGAGAGAGGGAGAGGAAGCCGCT Gene        : PRAME
Segment#    : 1
Offset      : 1
1st Codon   : 1
  A  A  M  E  R  R  R  L  W  G  S  I  Q  S  R  Y  I  S  M  S  V  W  T  S  P  R  R  L  V  E
GCCGCTATGGAAAGGAGAAGGCTCTGGGGAAGCATTCAGTCCAGGTATATCTCCATGTCCGTGTGGACCTCCCCCAGAAGGCTCGTGGAA Gene        : PRAME
Segment#    : 2
Offset      : 16
1st Codon   : 1
  Y  I  S  M  S  V  W  T  S  P  R  R  L  V  E  L  A  G  Q  S  L  L  K  D  E  A  L  A  I  A
TACATTAGCATGAGCGTCTGGACAAGCCCTAGGAGACTGGTCGAGCTCGCCGGACAGTCCCTGCTCAAGGATGAGGCTCTGGCTATCGCT Gene        : PRAME
Segment#    : 3
Offset      : 31
1st Codon   : 1
  L  A  G  Q  S  L  L  K  D  E  A  L  A  I  A  A  L  E  L  L  P  R  E  L  F  P  P  L  F  M
CTGGCTGGCCAAAGCCTCCTGAAAGACGAAGCCCTCGCCATTGCCGCTCTGGAACTGCTCCCCAGAGAGCTCTTCCCTCCCCTCTTCATG
```

Figure 27 (Cont)

```
Gene       : PRAME
Segment#   : 4
Offset     : 46
1st Codon  : 1
  A  L  E  L  L  P  R  E  L  F  P  P  L  F  M  A  A  F  D  G  R  H  S  Q  T  L  K  A  M  V
GCCCTCGAGCTCCTGCCTAGGGAACTGTTTCCCCCTCTGTTTATGGCTGCCTTTGACGGAAGGCATAGCCAAACCCTCAAGGCTATGGTC Gene       : PRAME
Segment#   : 5
Offset     : 61
1st Codon  : 1
  A  A  F  D  G  R  H  S  Q  T  L  K  A  M  V  Q  A  W  P  F  T  C  L  P  L  G  V  L  M  K
GCCGCTTTCGATGGCAGACACTCCCAGACACTGAAAGCCATGGTGCAAGCCTGGCCCTTTACCTGTCTGCCTCTGGGAGTGCTCATGAAA Gene       : PRAME
Segment#   : 6
Offset     : 76
1st Codon  : 1
  Q  A  W  P  F  T  C  L  P  L  G  V  L  M  K  G  Q  H  L  H  L  E  T  F  K  A  V  L  D  G
CAGGCTTGGCCTTTCACATGCCTCCCCCTCGGCGTCCTGATGAAGGGACAGCATCTGCATCTGGAAACCTTTAAGGCTGTGCTCGACGGA Gene       : PRAME
Segment#   : 7
Offset     : 91
1st Codon  : 1
  G  Q  H  L  H  L  E  T  F  K  A  V  L  D  G  L  D  V  L  L  A  Q  E  V  R  P  R  R  W  K
GGCCAACACCTCCACCTCGAGACATTCAAAGCCGTCCTGGATGGCCTCGACGTCCTGCTCGCCCAAGAGGTCAGGCCTAGGAGATGGAAA Gene       : PRAME
Segment#   : 8
Offset     : 106
1st Codon  : 1
  L  D  V  L  L  A  Q  E  V  R  P  R  R  W  K  L  Q  V  L  D  L  R  K  N  S  H  Q  D  F  W
CTGGATGTGCTCCTGGCTCAGGAAGTGAGACCCAGAAGGTGGAAGCTCCAGGTCCTGGATCTGAGAAAGAATAGCCATCAGGATTTCTGG Gene       : PRAME
Segment#   : 9
Offset     : 121
1st Codon  : 1
  L  Q  V  L  D  L  R  K  N  S  H  Q  D  F  W  T  V  W  S  G  N  R  A  S  L  Y  S  F  P  E
CTGCAAGTGCTCGACCTCAGGAAAAACTCCCACCAAGACTTTTGGACAGTGTGGAGCGGAAACAGAGCCTCCCTGTATAGCTTTCCCGAA Gene       : PRAME
Segment#   : 10
Offset     : 136
1st Codon  : 1
  T  V  W  S  G  N  R  A  S  L  Y  S  F  P  E  P  E  A  A  Q  P  M  T  K  K  R  K  V  D  G
ACCGTCTGGTCCGGCAATAGGGCTAGCCTCTACTCCTTCCCTGAGCCTGAGGCTGCCCAACCCATGACCAAAAAGAGAAAGGTCGACGGA Gene       : PRAME
Segment#   : 11
Offset     : 151
1st Codon  : 1
  P  E  A  A  Q  P  M  T  K  K  R  K  V  D  G  L  S  T  E  A  E  Q  P  F  I  P  V  E  V  L
CCCGAAGCCGCTCAGCCTATGACAAAGAAAAGGAAAGTGGATGGCCTCAGCACAGAGGCTGAGCAACCCTTTATCCCTGTGGAAGTGCTC Gene       : PRAME
Segment#   : 12
Offset     : 166
1st Codon  : 1
  L  S  T  E  A  E  Q  P  F  I  P  V  E  V  L  V  D  L  F  L  K  E  G  A  C  D  E  L  F  S
CTGTCCACCGAAGCCGAACAGCCTTTCATTCCCGTCGAGGTCCTGGTCGACCTCTTCCTCAAGGAAGGCGCTTGCGATGAGCTCTTCTCC Gene       : PRAME
Segment#   : 13
Offset     : 181
1st Codon  : 1
  V  D  L  F  L  K  E  G  A  C  D  E  L  F  S  Y  L  I  E  K  V  K  R  K  K  N  V  L  R  L
GTGGATCTGTTTCTGAAAGAGGGAGCCTGTGACGAACTGTTTAGCTATCTGATTGAGAAAGTGAAAAGGAAAAAGAATGTGCTCAGGCTC Gene       : PRAME
Segment#   : 14
```

Figure 27 (Cont)

Offset     : 196
1st Codon  : 1
   Y   L   I   E   K   V   K   R   K   K   N   V   L   R   L   C   C   K   K   L   K   I   F   A   M   P   M   Q   D   I
TACCTCATCGAAAAGGTCAAGAGAAAGAAAAACGTCCTGAGACTGTGTTGCAAAAAGCTCAAGATTTTCGCTATGCCTATGCAAGACATT Gene       : PRAME
Segment#   : 15
Offset     : 211
1st Codon  : 1
   C   C   K   K   L   K   I   F   A   M   P   M   Q   D   I   K   M   I   L   K   M   V   Q   L   D   S   I   E   D   L
TGCTGTAAGAAACTGAAAATCTTTGCCATGCCCATGCAGGATATCAAAATGATTCTGAAAATGGTCCAGCTCGACTCCATCGAAGACCTC Gene       : PRAME
Segment#   : 16
Offset     : 226
1st Codon  : 1
   K   M   I   L   K   M   V   Q   L   D   S   I   E   D   L   E   V   T   C   T   W   K   L   P   T   L   A   K   F   S
AAGATGATCCTCAAGATGGTGCAACTGGATAGCATTGAGGATCTGGAAGTGACATGCACATGGAAACTGCCTACCCTCGCCAAATTCTCC Gene       : PRAME
Segment#   : 17
Offset     : 241
1st Codon  : 1
   E   V   T   C   T   W   K   L   P   T   L   A   K   F   S   P   Y   L   G   Q   M   I   N   L   R   R   L   L   L   S
GAGGTCACCTGTACCTGGAAGCTCCCCACACTGGCTAAGTTTAGCCCTTACCTCGGCCAAATGATTAACCTCAGGAGACTGCTCCTGTCC Gene       : PRAME
Segment#   : 18
Offset     : 256
1st Codon  : 1
   P   Y   L   G   Q   M   I   N   L   R   R   L   L   L   S   H   I   H   A   S   S   Y   I   S   P   E   K   E   E   Q
CCCTATCTGGGACAGATGATCAATCTGAGAAGGCTCCTGCTCAGCCATATCCATGCCTCCAGCTATATCTCCCCCGAAAAGGAAGAGCAA Gene       : PRAME
Segment#   : 19
Offset     : 271
1st Codon  : 1
   H   I   H   A   S   S   Y   I   S   P   E   K   E   E   Q   Y   I   A   Q   F   T   S   Q   F   L   S   L   Q   C   L
CACATTCACGCTAGCTCCTACATTAGCCCTGAGAAAGAGGAACAGTATATCGCTCAGTTTACCTCCCAGTTTCTGTCCCTGCAATGCCTC Gene       : PRAME
Segment#   : 20
Offset     : 286
1st Codon  : 1
   Y   I   A   Q   F   T   S   Q   F   L   S   L   Q   C   L   Q   A   L   Y   V   D   S   L   F   F   L   R   G   R   L
TACATTGCCCAATTCACAAGCCAATTCCTCAGCCTCCAGTGTCTGCAAGCCCTCTACGTCGACTCCCTGTTTTTTCCTCAGGGGAAGGCTC Gene       : PRAME
Segment#   : 21
Offset     : 301
1st Codon  : 1
   Q   A   L   Y   V   D   S   L   F   F   L   R   G   R   L   D   Q   L   L   R   H   V   M   N   P   L   E   T   L   S
CAGGCTCTGTATGTGGATAGCCTCTTCTTTCTGAGAGGCAGACTGGATCAGCTCCTGAGACACGTCATGAATCCCCTCGAGACACTGTCC Gene       : PRAME
Segment#   : 22
Offset     : 316
1st Codon  : 1
   D   Q   L   L   R   H   V   M   N   P   L   E   T   L   S   I   T   N   C   R   L   S   E   G   D   V   M   H   L   S
GACCAACTGCTCAGGCATGTGATGAACCCTCTGGAAACCCTCAGCATTACCAATTGCAGACTGTCCGAGGGAGACGTCATGCATCTGTCC Gene       : PRAME
Segment#   : 23
Offset     : 331
1st Codon  : 1
   I   T   N   C   R   L   S   E   G   D   V   M   H   L   S   Q   S   P   S   V   S   Q   L   S   V   L   S   L   S   G
ATCACAAACTGTAGGCTCAGCGAAGGCGATGTGATGCACCTCAGCCAAAGCCCTAGCGTCAGCCAACTGTCCGTGCTCAGCCTCAGCGGA Gene       : PRAME
Segment#   : 24
Offset     : 346
1st Codon  : 1

Figure 27 (Cont)

```
Q  S  P  S  V  S  Q  L  S  V  L  S  L  S  G  V  M  L  T  D  V  S  P  E  P  L  Q  A  L  L
CAGTCCCCCTCCGTGTCCCAGCTCAGCGTCCTGTCCCTGTCCGGCGTCATGCTCACCGATGTGTCCCCCGAACCCCTCCAGGCTCTGCTC

Gene      : PRAME
Segment#  : 25
Offset    : 361
1st Codon : 1
V  M  L  T  D  V  S  P  E  P  L  Q  A  L  L  E  R  A  S  A  T  L  Q  D  L  V  F  D  E  C
GTGATGCTGACAGACGTCAGCCCTGAGCCTCTGCAAGCCCTCCTGGAAAGGGCTAGCGCTACCCTCCAGGATCTGGTCTTCGATGAGTGT Gene      : PRAME
Segment#  : 26
Offset    : 376
1st Codon : 1
E  R  A  S  A  T  L  Q  D  L  V  F  D  E  C  G  I  T  D  D  Q  L  L  A  L  L  P  S  L  S
GAGAGAGCCTCCGCCACACTGCAAGACCTCGTGTTTGACGAATGCGGAATCACAGACGATCAGCTCCTGGCTCTGCTCCCCTCCCTGTCC Gene      : PRAME
Segment#  : 27
Offset    : 391
1st Codon : 1
G  I  T  D  D  Q  L  L  A  L  L  P  S  L  S  H  C  S  Q  L  T  T  L  S  F  Y  G  N  S  I
GGCATTACCGATGACCAACTGCTCGCCCTCCTGCCTAGCCTCAGCCATTGCTCCCAGCTCACCACACTGTCCTTCTATGGCAATAGCATT Gene      : PRAME
Segment#  : 28
Offset    : 406
1st Codon : 1
H  C  S  Q  L  T  T  L  S  F  Y  G  N  S  I  S  I  S  A  L  Q  S  L  L  Q  H  L  I  G  L
CACTGTAGCCAACTGACAACCCTCAGCTTTTACGGAAACTCCATCTCCATCTCCGCCCTCCAGTCCCTGCTCCAGCATCTGATTGGCCTC Gene      : PRAME
Segment#  : 29
Offset    : 421
1st Codon : 1
S  I  S  A  L  Q  S  L  L  Q  H  L  I  G  L  S  N  L  T  H  V  L  Y  P  V  P  L  E  S  Y
AGCATTAGCGCTCTGCAAAGCCTCCTGCAACACCTCATCGGACTGTCCAACCTCACCCATGTGCTCTACCCTGTGCCTCTGGAAAGCTAT Gene      : PRAME
Segment# : 30
Offset    : 436
1st Codon : 1
S  N  L  T  H  V  L  Y  P  V  P  L  E  S  Y  E  D  I  H  G  T  L  H  L  E  R  L  A  Y  L
AGCAATCTGACACACGTCCTGTATCCCGTCCCCCTCGAGTCCTACGAAGACATTCACGGAACCCTCCACCTCGAGAGACTGGCTTACCTC Gene      : PRAME
Segment#  : 31
Offset    : 451
1st Codon : 1
E  D  I  H  G  T  L  H  L  E  R  L  A  Y  L  H  A  R  L  R  E  L  L  C  E  L  G  R  P  S
GAGGATATCCATGGCACACTGCATCTGGAAAGGCTCGCCTATCTGCATGCCAGACTGAGAGAGCTCCTGTGTGAGCTCGGCAGACCCTCC Gene      : PRAME
Segment#  : 32
Offset    : 466
1st Codon : 1
H  A  R  L  R  E  L  L  C  E  L  G  R  P  S  M  V  W  L  S  A  N  P  C  P  H  C  G  D  R
CACGCTAGGCTCAGGGAACTGCTCTGCGAACTGGGAAGGCCTAGCATGGTGTGGCTGTCCGCCAATCCCTGTCCCCATTGCGGAGACAGA Gene      : PRAME
Segment#  : 33
Offset    : 481
1st Codon : 1
M  V  W  L  S  A  N  P  C  P  H  C  G  D  R  T  F  Y  D  P  E  P  I  L  C  P  C  F  M  P
ATGGTCTGGCTCAGCGCTAACCCTTGCCCTCACTGTGGCGATAGGACATTCTATGACCCTGAGCCTATCCTCTGCCCTTGCTTTATGCCT Gene      : PRAME
Segment#  : 34
Offset    : 496
1st Codon : 1
T  F  Y  D  P  E  P  I  L  C  P  C  F  M  P  N  A  A
ACCTTTTACGATCCCGAACCCATTCTGTGTCCCTGTTTCATGCCCAATGCCGCT
```

Figure 27 (Cont)

```
Gene       : TRP2IN2
Segment#   : 1
Offset     : 1
1st Codon  : 1
 A  A  L  M  E  T  H  L  S  S  K  R  Y  T  E  E  A  G  G  F  F  P  W  L  K  V  Y  Y  Y  R
GCCGCTCTGATGGAGACACACCTCAGCTCCAAGAGATACACAGAGGAAGCCGGAGGCTTTTTCCCTTGGCTCAAGGTCTACTATTACAGA Gene       : TRP2IN2
Segment#   : 2
Offset     : 16
1st Codon  : 1
 E  A  G  G  F  F  P  W  L  K  V  Y  Y  Y  R  F  V  I  G  L  R  V  W  Q  W  E  V  I  S  C
GAGGCTGGCGGATTCTTTCCCTGGCTGAAAGTGTATTACTATAGGTTTGTGATTGGCCTCAGGGTCTGGCAATGGGAAGTGATTAGCTGT Gene       : TRP2IN2
Segment#   : 3
Offset     : 31
1st Codon  : 1
 F  V  I  G  L  R  V  W  Q  W  E  V  I  S  C  K  L  I  K  R  A  T  T  R  Q  P  A  A
TTCGTCATCGGACTGAGAGTGTGGCAGTGGGAGGTCATCTCCTGCAAACTGATTAAGAGAGCCACAACCAGACAGCCTGCCGCT Gene       : NYNS01a
Segment#   : 1
Offset     : 1
1st Codon  : 1
 A  A  M  Q  A  E  G  R  G  T  G  G  S  T  G  D  A  D  G  P  G  G  P  G  I  P  D  G  P  G
GCCGCTATGCAAGCCGAAGGCAGAGGCACAGGCGGAAGCACAGGCGATGCCGATGGCCCTGGCGGACCCGGAATCCCTGACGGACCCGGA Gene       : NYNS01a
Segment#   : 2
Offset     : 16
1st Codon  : 1
 D  A  D  G  P  G  G  P  G  I  P  D  G  P  G  G  N  A  G  G  P  G  E  A  G  A  T  G  G  R
GACGCTGACGGACCCGGAGGCCCTGGCATTCCCGATGGCCCTGGCGGAAACGCTGGCGGACCCGGAGAGGCTGGCGCTACCGGAGGCAGA Gene       : NYNS01a
Segment#   : 3
Offset     : 31
1st Codon  : 1
 G  N  A  G  G  P  G  E  A  G  A  T  G  G  R  G  P  R  G  A  G  A  A  R  A  S  G  P  G  G
GGCAATGCCGGAGGCCCTGGCGAAGCCGGAGCCACAGGCGGAAGGGGACCCAGAGGCGCTGGCGCTGCCAGAGCCTCCGGCCCTGGCGGA Gene       : NYNS01a
Segment#   : 4
Offset     : 46
1st Codon  : 1
 G  P  R  G  A  G  A  A  R  A  S  G  P  G  G  G  A  P  R  G  P  H  G  G  A  A  S  G  L  N
GGCCCTAGGGGAGCCGGAGCCGCTAGGGCTAGCGGACCCGGAGGCGGAGCCCCTAGGGGACCCCATGGCGGAGCCGCTAGCGGACTGAAT Gene       : NYNS01a
Segment#   : 5
Offset     : 61
1st Codon  : 1
 G  A  P  R  G  P  H  G  G  A  A  S  G  L  N  G  C  C  R  C  G  A  R  G  P  E  S  R  L  L
GGCGCTCCCAGAGGCCCTCACGGAGGCGCTGCCTCCGGCCTCAACGGATGCTGTAGGTGTGGCGCTAGGGGACCCGAAAGCAGACTGCTC Gene       : NYNS01a
Segment#   : 6
Offset     : 76
1st Codon  : 1
 G  C  C  R  C  G  A  R  G  P  E  S  R  L  L  E  F  Y  L  A  M  P  F  A  T  P  M  E  A  E
GGCTGTTGCAGATGCGGAGCCAGAGGCCCTGAGTCCAGGCTCCTGGAATTCTATCTGGCTATGCCTTTCGCTACCCCTATGGAAGCCGAA Gene       : NYNS01a
Segment#   : 7
Offset     : 91
1st Codon  : 1
 E  F  Y  L  A  M  P  F  A  T  P  M  E  A  E  L  A  R  R  S  L  A  Q  D  A  P  P  L  P  V
GAGTTTTACCTCGCCATGCCCTTTGCCACACCCATGGAGGCTGAGCTCGCCAGAAGGTCCCTGGCTCAGGATGCCCCTCCCCTCCCCGTC Gene       : NYNS01a
```

```
Segment#  : 8
Offset    : 106
1st Codon : 1
  L   A   R   R   S   L   A   Q   D   A   P   P   L   P   V   P   G   V   L   L   K   E   F   T   V   S   G   N   I   L
CTGGCTAGGAGAAGCCTCGCCCAAGACGCTCCCCCTCTGCCTGTGCCTGGCGTCCTGCTCAAGGAATTCACAGTGTCCGGCAATATCCTC Gene      : NYNS01a
Segment#  : 9
Offset    : 121
1st Codon : 1
  P   G   V   L   L   K   E   F   T   V   S   G   N   I   L   T   I   R   L   T   A   A   D   H   R   Q   L   Q   L   S
CCCGGAGTGCTCCTGAAAGAGTTTACCGTCAGCGGAAACATTCTGACAATCAGACTGACAGCCGCTGACCATAGGCAACTGCAACTGTCC Gene      : NYNS01a
Segment#  : 10
Offset    : 136
1st Codon : 1
  T   I   R   L   T   A   A   D   H   R   Q   L   Q   L   S   I   S   S   C   L   Q   Q   L   S   L   L   M   W   I   T
ACCATTAGGCTCACCGCTGCCGATCACAGACAGCTCCAGCTCAGCATTAGCTCCTGCCTCCAGCAACTGTCCCTGCTCATGTGGATCACA Gene      : NYNS01a
Segment#  : 11
Offset    : 151
1st Codon : 1
  I   S   S   C   L   Q   Q   L   S   L   L   M   W   I   T   Q   C   F   L   P   V   F   L   A   Q   P   P   S   G   Q
ATCTCCAGCTGTCTGCAACAGCTCAGCCTCCTGATGTGGATTACCCAATGCTTTCTGCCTGTGTTTCTGGCTCAGCCTCCCTCCGGCCAA Gene      : NYNS01a
Segment#  : 12
Offset    : 166
1st Codon : 1
  Q   C   F   L   P   V   F   L   A   Q   P   P   S   G   Q   R   R   A   A
CAGTGTTTCCTCCCCGTCTTCCTCGCCCAACCCCCTAGCGGACAGAGAAGGGCTGCC Gene      : NYNS01b
Segment#  : 1
Offset    : 1
1st Codon : 1
  A   A   M   L   M   A   Q   E   A   L   A   F   L   M   A   Q   G   A   M   L   A   A   Q   E   R   R   V   P   R   A
GCCGCTATGCTCATGGCTCAGGAAGCCCTCGCCTTTCTGATGGCCCAAGGCGCTATGCTCGCCGCTCAGGAAAGGAGAGTGCCTAGGGCT Gene      : NYNS01b
Segment#  : 2
Offset    : 16
1st Codon : 1
  Q   G   A   M   L   A   A   Q   E   R   R   V   P   R   A   A   E   V   P   G   A   Q   G   Q   Q   G   P   R   G   R
CAGGGAGCCATGCTGGCTGCCCAAGAGAGAAGGGTCCCCAGAGCCGCTGAGGTCCCCGGAGCCCAAGGCCAACAGGGACCCAGAGGCAGA Gene      : NYNS01b
Segment#  : 3
Offset    : 31
1st Codon : 1
  A   E   V   P   G   A   Q   G   Q   Q   G   P   R   G   R   E   E   A   P   R   G   V   R   M   A   A   R   L   Q   G
GCCGAAGTGCCTGGCGCTCAGGGACAGCAAGGCCCTAGGGGAAGGGAAGAGGCTCCCAGAGGCGTCAGGATGGCCGCTAGGCTCCAGGGA Gene      : NYNS01b
Segment#  : 4
Offset    : 46
1st Codon : 1
  E   E   A   P   R   G   V   R   M   A   A   R   L   Q   G   A   A
GAGGAAGCCCCTAGGGGAGTGAGAATGGCTGCCAGACTGCAAGGCGCTGCC Gene      : LAGE1
Segment#  : 1
Offset    : 1
1st Codon : 1
  A   A   M   Q   A   E   G   Q   G   T   G   G   S   T   G   D   A   D   G   P   G   G   P   G   I   P   D   G   P   G
GCCGCTATGCAAGCCGAAGGCCAAGGCACAGGCGGAAGCACAGGCGATGCCGATGGCCCTGGCGGACCCGGAATCCCTGACGGACCCGGA Gene      : LAGE1
Segment#  : 2
Offset    : 16
```

Figure 27 (Cont)

```
1st Codon : 1
  D   A   D   G   P   G   G   P   G   I   P   D   G   P   G   G   N   A   G   G   P   G   E   A   G   A   T   G   G   R
GACGCTGACGGACCCGGAGGCCCTGGCATTCCCGATGGCCCTGGCGGAAACGCTGGCGGACCCGGAGAGGCTGGCGCTACCGGAGGCAGA Gene       : LAGE1
Segment#   : 3
Offset     : 31
1st Codon  : 1
  G   N   A   G   G   P   G   E   A   G   A   T   G   G   R   G   P   R   G   A   G   A   A   R   A   S   G   P   R   G
GGCAATGCCGGAGGCCCTGGCGAAGCCGGAGCCACAGGCGGAAGGGGACCCAGAGGCGCTGGCGCTGCCAGAGCCTCCGGCCCTAGGGGA Gene       : LAGE1
Segment#   : 4
Offset     : 46
1st Codon  : 1
  G   P   R   G   A   G   A   A   R   A   S   G   P   R   G   G   A   P   R   G   P   H   G   G   A   A   S   A   Q   D
GGCCCTAGGGGAGCCGGAGCCGCTAGGGCTAGCGGACCCAGAGGCGGAGCCCCTAGGGGACCCCATGGCGGAGCCGCTAGCGCTCAGGAT Gene       : LAGE1
Segment#   : 5
Offset     : 61
1st Codon  : 1
  G   A   P   R   G   P   H   G   G   A   A   S   A   Q   D   G   R   C   P   C   G   A   R   R   P   D   S   R   L   L
GGCGCTCCCAGAGGCCCTCACGGAGGCGCTGCCTCCGCCCAAGACGGAAGGTGTCCCTGTGGCGCTAGGAGACCCGATAGCAGACTGCTC Gene       : LAGE1
Segment#   : 6
Offset     : 76
1st Codon  : 1
  G   R   C   P   C   G   A   R   R   P   D   S   R   L   L   Q   L   H   I   T   M   P   F   S   S   P   M   E   A   E
GGCAGATGCCCTTGCGGAGCCAGAAGGCCTGACTCCAGGCTCCTGCAACTGCATATCACAATGCCTTTCTCCAGCCCTATGGAAGCCGAA Gene       : LAGE1
Segment#   : 7
Offset     : 91
1st Codon  : 1
  Q   L   H   I   T   M   P   F   S   S   P   M   E   A   E   L   V   R   R   I   L   S   R   D   A   A   P   L   P   R
CAGCTCCACATTACCATGCCCTTTAGCTCCCCCATGGAGGCTGAGCTCGTGAGAAGGATTCTGTCCAGGGATGCCGCTCCCCTCCCCAGA Gene       : LAGE1
Segment#   : 8
Offset     : 106
1st Codon  : 1
  L   V   R   R   I   L   S   R   D   A   A   P   L   P   R   P   G   A   V   L   K   D   F   T   V   S   G   N   L   L
CTGGTCAGGAGAATCCTCAGCAGAGACGCTGCCCCTCTGCCTAGGCCTGGCGCTGTGCTCAAGGATTTCACAGTGTCCGGCAATCTGCTC Gene       : LAGE1
Segment#   : 9
Offset     : 121
1st Codon  : 1
  P   G   A   V   L   K   D   F   T   V   S   G   N   L   L   F   I   R   L   T   A   A   D   H   R   Q   L   Q   L   S
CCCGGAGCCGTCCTGAAAGACTTTACCGTCAGCGGAAACCTCCTGTTTATCAGACTGACAGCCGCTGACCATAGGCAACTGCAACTGTCC Gene       : LAGE1
Segment#   : 10
Offset     : 136
1st Codon  : 1
  F   I   R   L   T   A   A   D   H   R   Q   L   Q   L   S   I   S   S   C   L   Q   Q   L   S   L   L   M   W   I   T
TTCATTAGGCTCACCGCTGCCGATCACAGACAGCTCCAGCTCAGCATTAGCTCCTGCCTCCAGCAACTGTCCCTGCTCATGTGGATCACA Gene       : LAGE1
Segment#   : 11
Offset     : 151
1st Codon  : 1
  I   S   S   C   L   Q   Q   L   S   L   L   M   W   I   T   Q   C   F   L   P   V   F   L   A   Q   A   P   S   G   Q
ATCTCCAGCTGTCTGCAACAGCTCAGCCTCCTGATGTGGATTACCCAATGCTTTCTGCCTGTGTTTCTGGCTCAGGCTCCCTCCGGCCAA Gene       : LAGE1
Segment#   : 12
Offset     : 166
1st Codon  : 1
  Q   C   F   L   P   V   F   L   A   Q   A   P   S   G   Q   R   R   A   A
```

Figure 27 (Cont)

```
CAGTGTTTCCTCCCCGTCTTCCTCGCCCAAGCCCCTAGCGGACAGAGAAGGGCTGCC

Segments in scrambled order:
-------------------------------
MAGE-1 #15
 A  P  E  E  E  I  W  E  E  L  S  V  M  E  V  Y  D  G  R  E  H  S  A  Y  G  E  P  R  K  L
GCCCCTGAGGAAGAGATTTGGGAAGAGCTCAGCGTCATGGAAGTGTATGACGGAAGGGAACACTCCGCCTATGGCGAACCCAGAAAGCTC MAGE-1 #4
 E  E  V  P  T  A  G  S  T  D  P  P  Q  S  P  Q  G  A  S  A  F  P  T  T  I  N  F  T  R  Q
GAGGAAGTGCCTACCGCTGGCTCCACCGATCCCCCTCAGTCCCCCCAAGGCGCTAGCGCTTTCCCTACCACAATCAATTTCACAAGGCAA PRAME #10
 T  V  W  S  G  N  R  A  S  L  Y  S  F  P  E  P  E  A  A  Q  P  M  T  K  K  R  K  V  D  G
ACCGTCTGGTCCGGCAATAGGGCTAGCCTCTACTCCTTCCCTGAGCCTGAGGCTGCCCAACCCATGACCAAAAAGAGAAAGGTCGACGGA MAGE-3 #14
 Q  I  M  P  K  A  G  L  L  I  I  V  L  A  I  I  A  R  E  G  D  C  A  P  E  E  K  I  W  E
CAGATTATGCCTAAGGCTGGCCTCCTGATTATCGTCCTGGCTATCATTGCCAGAGAGGGAGACTGTGCCCCTGAGGAAAAGATTTGGGAA PRAME #9
 L  Q  V  L  D  L  R  K  N  S  H  Q  D  F  W  T  V  W  S  G  N  R  A  S  L  Y  S  F  P  E
CTGCAAGTGCTCGACCTCAGGAAAAACTCCCACCAAGACTTTTGGACAGTGTGGAGCGGAAACAGAGCCTCCCTGTATAGCTTTCCCGAA PRAME #8
 L  D  V  L  L  A  Q  E  V  R  P  R  R  W  K  L  Q  V  L  D  L  R  K  N  S  H  Q  D  F  W
CTGGATGTGCTCCTGGCTCAGGAAGTGAGACCCAGAAGGTGGAAGCTCCAGGTCCTGGATCTGAGAAAGAATAGCCATCAGGATTTCTGG NYNSO1b #2
 Q  G  A  M  L  A  A  Q  E  R  R  V  P  R  A  A  E  V  P  G  A  Q  G  Q  Q  G  P  R  G  R
CAGGGAGCCATGCTGGCTGCCCAAGAGAGAAGGGTCCCCAGAGCCGCTGAGGTCCCCGGAGCCCAAGGCCAACAGGGACCCAGAGGCAGA PRAME #24
 Q  S  P  S  V  S  Q  L  S  V  L  S  L  S  G  V  M  L  T  D  V  S  P  E  P  L  Q  A  L  L
CAGTCCCCCTCCGTGTCCCAGCTCAGCGTCCTGTCCCTGTCCGGCGTCATGCTCACCGATGTGTCCCCCGAACCCCTCCAGGCTCTGCTC MAGE-1 #17
 L  T  Q  D  L  V  Q  E  K  Y  L  E  Y  R  Q  V  P  D  S  D  P  A  R  Y  E  F  L  W  G  P
CTGACACAGGATCTGGTCCAGGAAAAGTATCTGGAATACAGACAGGTCCCCGATAGCGATCCCGCTAGGTATGAGTTTCTGTGGGGCCCT MAGE-1 #6
 R  Q  P  S  E  G  S  S  S  R  E  E  E  G  P  S  T  S  C  I  L  E  S  L  F  R  A  V  I  T
AGGCAACCCTCCGAGGGAAGCTCCAGCAGAGAGGAAGAGGGACCCTCCACCTCCTGCATTCTGGAAAGCCTCTTCAGAGCCGTCATCACA BAGE #1
 A  A  M  A  A  R  A  V  F  L  A  L  S  A  Q  L  L  Q  A  R  L  M  K  E  E  S  P  V  V  S
GCCGCTATGGCTGCCAGAGCCGTCTTCCTCGCCCTCAGCGCTCAGCTCCTGCAAGCCAGACTGATGAAGGAAGAGTCCCCCGTCGTGTCC PRAME #34
 T  F  Y  D  P  E  P  I  L  C  P  C  F  M  P  N  A  A
ACCTTTTACGATCCCGAACCCATTCTGTGTCCCTGTTTCATGCCCAATGCCGCT MAGE-3 #12
 I  E  L  M  E  V  D  P  I  G  H  L  Y  I  F  A  T  C  L  G  L  S  Y  D  G  L  L  G  D  N
ATCGAACTGATGGAGGTCGACCCTATCGGACACCTCTACATTTTCGCTACCTGTCTGGGACTGTCCTACGATGGCCTCCTGGGAGACAAT GAGE-1 #2
 R  R  Y  V  E  P  P  E  M  I  G  P  M  R  P  E  Q  F  S  D  E  V  E  P  A  T  P  E  E  G
AGGAGATACGTCGAGCCTCCCGAAATGATTGGCCCTATGAGACCCGAACAGTTTAGCGATGAGGTCGAGCCTGCCACACCCGAAGAGGGA TRP2IN2 #2
 E  A  G  G  F  F  P  W  L  K  V  Y  Y  Y  R  F  V  I  G  L  R  V  W  Q  W  E  V  I  S  C
GAGGCTGGCGGATTCTTTCCCTGGCTGAAAGTGTATTACTATAGGTTTGTGATTGGCCTCAGGGTCTGGCAATGGGAAGTGATTAGCTGT PRAME #1
 A  A  M  E  R  R  R  L  W  G  S  I  Q  S  R  Y  I  S  M  S  V  W  T  S  P  R  R  L  V  E
GCCGCTATGGAAAGGAGAAGGCTCTGGGGAAGCATTCAGTCCAGGTATATCTCCATGTCCGTGTGGACCTCCCCCAGAAGGCTCGTGGAA TRP2IN2 #1
 A  A  L  M  E  T  H  L  S  S  K  R  Y  T  E  E  A  G  G  F  F  P  W  L  K  V  Y  Y  Y  R
GCCGCTCTGATGGAGACACACCTCAGCTCCAAGAGATACACAGAGGAAGCCGGAGGCTTTTTCCCTTGGCTCAAGGTCTACTATTACAGA
```

Figure 27 (Cont)

```
MAGE-1 #1
  A  A  M  S  L  E  Q  R  S  L  H  C  K  P  E  E  A  L  E  A  Q  Q  E  A  L  G  L  V  C  V
GCCGCTATGTCCCTGGAACAGAGAAGCCTCCACTGTAAGCCTGAGGAAGCCCTCGAGGCTCAGCAAGAGGCTCTGGGACTGGTCTGCGTC

MAGE-1 #3
  Q  A  A  T  S  S  S  S  P  L  V  L  G  T  L  E  E  V  P  T  A  G  S  T  D  P  P  Q  S  P
CAGGCTGCCACAAGCTCCAGCTCCCCCCTCGTGCTCGGCACACTGGAAGAGGTCCCCACAGCCGGAAGCACAGACCCTCCCCAAAGCCCT

PRAME #4
  A  L  E  L  L  P  R  E  L  F  P  P  L  F  M  A  A  F  D  G  R  H  S  Q  T  L  K  A  M  V
GCCCTCGAGCTCCTGCCTAGGGAACTGTTTCCCCCTCTGTTTATGGCTGCCTTTGACGGAAGGCATAGCCAAACCCTCAAGGCTATGGTC

MAGE-3 #16
  E  L  S  V  L  E  V  F  E  G  R  E  D  S  I  L  G  D  P  K  K  L  L  T  Q  H  F  V  Q  E
GAGCTCAGCGTCCTGGAAGTGTTTGAGGGAAGGGAAGACTCCATCCTCGGCGATCCCAAAAAGCTCCTGACACAGCATTTCGTCCAGGAA

MAGE-1 #11
  E  S  L  Q  L  V  F  G  I  D  V  K  E  A  D  P  T  G  H  S  Y  V  L  V  T  C  L  G  L  S
GAGTCCCTGCAACTGGTCTTCGGAATCGATGTGAAAGAGGCTGACCCTACCGGACACTCCTACGTCCTGGTCACCTGTCTGGGACTGTCC

MAGE-3 #5
  P  D  P  P  Q  S  P  Q  G  A  S  S  L  P  T  T  M  N  Y  P  L  W  S  Q  S  Y  E  D  S  S
CCCGATCCCCCTCAGTCCCCCCAAGGCGCTAGCTCCCTGCCTACCACAATGAATTACCCTCTGTGGAGCCAAAGCTATGAGGATAGCTCC

LAGE1 #1
  A  A  M  Q  A  E  G  Q  G  T  G  G  S  T  G  D  A  D  G  P  G  G  P  G  I  P  D  G  P  G
GCCGCTATGCAAGCCGAAGGCCAAGGCACAGGCGGAAGCACAGGCGATGCCGATGGCCCTGGCGGACCCGGAATCCCTGACGGACCCGGA

NYNSO1a #12
  Q  C  F  L  P  V  F  L  A  Q  P  P  S  G  Q  R  R  A  A
CAGTGTTTCCTCCCCGTCTTCCTCGCCCAACCCCCTAGCGGACAGAGAAGGGCTGCC gp100In4 #2
  T  W  G  E  G  L  P  S  Q  P  I  I  H  T  C  V  Y  F  F  L  P  D  H  L  S  F  G  R  P  F
ACCTGGGGCGAAGGCCTCCCCTCCCAGCCTATCATTCACACATGCGTCTACTTTTTCCTCCCCGATCACCTCAGCTTTGGCAGACCCTTT

MAGE-1 #7
  S  T  S  C  I  L  E  S  L  F  R  A  V  I  T  K  K  V  A  D  L  V  G  F  L  L  L  K  Y  R
AGCACAAGCTGTATCCTCGAGTCCCTGTTTAGGGCTGTGATTACCAAAAAGGTCGCCGATCTGGTCGGCTTTCTGCTCCTGAAATACAGA

NYNSO1a #1
  A  A  M  Q  A  E  G  R  G  T  G  G  S  T  G  D  A  D  G  P  G  G  P  G  I  P  D  G  P  G
GCCGCTATGCAAGCCGAAGGCAGAGGCACAGGCGGAAGCACAGGCGATGCCGATGGCCCTGGCGGACCCGGAATCCCTGACGGACCCGGA

GAGE-1 #7
  D  G  P  D  G  Q  E  M  D  P  P  N  P  E  E  V  K  T  P  E  E  E  M  R  S  H  Y  V  A  Q
GACGGACCCGATGGCCAAGAGATGGACCCTCCCAATCCCGAAGAGGTCAAGACACCCGAAGAGGAAATGAGAAGCCATTACGTCGCCCAA

NYNSO1a #11
  I  S  S  C  L  Q  Q  L  S  L  L  M  W  I  T  Q  C  F  L  P  V  F  L  A  Q  P  P  S  G  Q
ATCTCCAGCTGTCTGCAACAGCTCAGCCTCCTGATGTGGATTACCCAATGCTTTCTGCCTGTGTTTCTGGCTCAGCCTCCCTCCGGCCAA

PRAME #26
  E  R  A  S  A  T  L  Q  D  L  V  F  D  E  C  G  I  T  D  D  Q  L  L  A  L  L  P  S  L  S
GAGAGAGCCTCCGCCACACTGCAAGACCTCGTGTTTGACGAATGCGGAATCACAGACGATCAGCTCCTGGCTCTGCTCCCCTCCCTGTCC

MAGE-3 #17
  L  G  D  P  K  K  L  L  T  Q  H  F  V  Q  E  N  Y  L  E  Y  R  Q  V  P  G  S  D  P  A  C
CTGGGAGACCCTAAGAAACTGCTCACCCAACACTTTGTGCAAGAGAATTACCTCGAGTATAGGCAAGTGCCTGGCTCCGACCCTGCCTGT

MAGE-1 #2
  E  A  L  E  A  Q  Q  E  A  L  G  L  V  C  V  Q  A  A  T  S  S  S  S  P  L  V  L  G  T  L
GAGGCTCTGGAAGCCCAACAGGAAGCCCTCGGCCTCGTGTGTGTGCAAGCCGCTACCTCCAGCTCCAGCCCTCTGGTCCTGGGAACCCTC

NYNSO1a #7
  E  F  Y  L  A  M  P  F  A  T  P  M  E  A  E  L  A  R  R  S  L  A  Q  D  A  P  P  L  P  V
GAGTTTTACCTCGCCATGCCCTTTGCCACACCCATGGAGGCTGAGCTCGCCAGAAGGTCCCTGGCTCAGGATGCCCCTCCCCTCCCCGTC

NYNSO1b #4
  E  E  A  P  R  G  V  R  M  A  A  R  L  Q  G  A  A
GAGGAAGCCCCTAGGGGAGTGAGAATGGCTGCCAGACTGCAAGGCGCTGCC
```

Figure 27 (Cont)

BAGE #3
W R L E P E D G T A L C F I F A A
TGGAGACTGGAACCCGAAGACGGAACCGCTCTGTGTTTCATTTTCGCTGCC

GAGE-1 #3
E Q F S D E V E P A T P E E G E P A T Q R Q D P A A A Q E G
GAGCAATTCTCCGACGAAGTGGAACCCGCTACCCCTGAGGAAGGCGAACCCGCTACCCAAAGGCAAGACCCTGCCGCTGCCCAAGAGGGA

MAGE-3 #6
T M N Y P L W S Q S Y E D S S N Q E E E G P S T F P D L E S
ACCATGAACTATCCCCTCTGGTCCCAGTCCTACGAAGACTCCAGCAATCAGGAAGAGGAAGGCCCTAGCACATTCCCTGACCTCGAGTCC

MAGE-3 #7
N Q E E E G P S T F P D L E S E F Q A A L S R K V A E L V H
AACCAAGAGGAAGAGGGACCCTCCACCTTTCCCGATCTGGAAAGCGAATTCCAAGCCGCTCTGTCCAGGAAAGTGGCTGAGCTCGTGCAT

PRAME #13
V D L F L K E G A C D E L F S Y L I E K V K R K K N V L R L
GTGGATCTGTTTCTGAAAGAGGGAGCCTGTGACGAACTGTTTAGCTATCTGATTGAGAAAGTGAAAAGGAAAAAGAATGTGCTCAGGCTC

NYNSO1a #10
T I R L T A A D H R Q L Q L S I S S C L Q Q L S L L M W I T
ACCATTAGGCTCACCGCTGCCGATCACAGACAGCTCCAGCTCAGCATTAGCTCCTGCCTCCAGCAACTGTCCCTGCTCATGTGGATCACA

MAGE-3 #1
A A M P L E Q R S Q H C K P E E G L E A R G E A L G L V G A
GCCGCTATGCCTCTGGAACAGAGAAGCCAACACTGTAAGCCTGAGGAAGGCCTCGAGGCTAGGGGAGAGGCTCTGGGACTGGTCGGCGCT

NYNSO1a #2
D A D G P G G P G I P D G P G G N A G G P G E A G A T G G R
GACGCTGACGGACCCGGAGGCCCTGGCATTCCCGATGGCCCTGGCGGAAACGCTGGCGGACCCGGAGAGGCTGGCGCTACCGGAGGCAGA

MAGE-3 #19
Y E F L W G P R A L V E T S Y V K V L H H M V K I S G G P H
TACGAATTCCTCTGGGGACCCAGAGCCCTCGTGGAAACCTCCTACGTCAAGGTCCTGCATCACATGGTGAAAATCTCCGGCGGACCCCAT

PRAME #23
I T N C R L S E G D V M H L S Q S P S V S Q L S V L S L S G
ATCACAAACTGTAGGCTCAGCGAAGGCGATGTGATGCACCTCAGCCAAAGCCCTAGCGTCAGCCAACTGTCCGTGCTCAGCCTCAGCGGA

MAGE-3 #18
N Y L E Y R Q V P G S D P A C Y E F L W G P R A L V E T S Y
AACTATCTGGAATACAGACAGGTCCCCGGAAGCGATCCCGCTTGCTATGAGTTTCTGTGGGGCCCTAGGGCTCTGGTCGAGACAAGCTAT

MAGE-3 #11
V I F S K A S S S L Q L V F G I E L M E V D P I G H L Y I F
GTGATTTTCTCCAAGGCTAGCTCCAGCCTCCAGCTCGTGTTTGGCATTGAGCTCATGGAAGTGGATCCCATTGGCCATCTGTATATCTTT

PRAME #21
Q A L Y V D S L F F L R G R L D Q L L R H V M N P L E T L S
CAGGCTCTGTATGTGGATAGCCTCTTCTTTCTGAGAGGCAGACTGGATCAGCTCCTGAGACACGTCATGAATCCCCTCGAGACACTGTCC

PRAME #20
Y I A Q F T S Q F L S L Q C L Q A L Y V D S L F F L R G R L
TACATTGCCCAATTCACAAGCCAATTCCTCAGCCTCCAGTGTCTGCAAGCCCTCTACGTCGACTCCCTGTTTTTCCTCAGGGGAAGGCTC

PRAME #7
G Q H L H L E T F K A V L D G L D V L L A Q E V R P R R W K
GGCCAACACCTCCACCTCGAGACATTCAAAGCCGTCCTGGATGGCCTCGACGTCCTGCTCGCCCAAGAGGTCAGGCCTAGGAGATGGAAA

LAGE1 #10
F I R L T A A D H R Q L Q L S I S S C L Q Q L S L L M W I T
TTCATTAGGCTCACCGCTGCCGATCACAGACAGCTCCAGCTCAGCATTAGCTCCTGCCTCCAGCAACTGTCCCTGCTCATGTGGATCACA

PRAME #15
C C K K L K I F A M P M Q D I K M I L K M V Q L D S I E D L
TGCTGTAAGAAACTGAAAATCTTTGCCATGCCCATGCAGGATATCAAAATGATTCTGAAAATGGTCCAGCTCGACTCCATCGAAGACCTC

NYNSO1a #5
G A P R G P H G G A A S G L N G C C R C G A R G P E S R L L
GGCGCTCCCAGAGGCCCTCACGGAGGCGCTGCCTCCGGCCTCAACGGATGCTGTAGGTGTGGCGCTAGGGGACCCGAAAGCAGACTGCTC

Figure 27 (Cont)

MAGE-1 #8
K  K  V  A  D  L  V  G  F  L  L  L  K  Y  R  A  R  E  P  V  T  K  A  E  M  L  E  S  V  I
AAGAAAGTGGCTGACCTCGTGGGATTCCTCCTGCTCAAGTATAGGGCTAGGGAACCCGTCACCAAAGCCGAAATGCTCGAGTCCGTGATT

MAGE-1 #13
Y  D  G  L  L  G  D  N  Q  I  M  P  K  T  G  F  L  I  I  V  L  V  M  I  A  M  E  G  G  H
TACGATGGCCTCCTGGGAGACAATCAGATTATGCCTAAGACAGGCTTTCTGATTATCGTCCTGGTCATGATTGCCATGGAGGGAGGCCAT

PRAME #29
S  I  S  A  L  Q  S  L  L  Q  H  L  I  G  L  S  N  L  T  H  V  L  Y  P  V  P  L  E  S  Y
AGCATTAGCGCTCTGCAAAGCCTCCTGCAACACCTCATCGGACTGTCCAACCTCACCCATGTGCTCTACCCTGTGCCTCTGGAAAGCTAT

MAGE-3 #15
I  A  R  E  G  D  C  A  P  E  E  K  I  W  E  E  L  S  V  L  E  V  F  E  G  R  E  D  S  I
ATCGCTAGGGAAGGCGATTGCGCTCCCGAAGAGAAAATCTGGGAGGAACTGTCCGTGCTCGAGGTCTTCGAAGGCAGAGAGGATAGCATT

PRAME #22
D  Q  L  L  R  H  V  M  N  P  L  E  T  L  S  I  T  N  C  R  L  S  E  G  D  V  M  H  L  S
GACCAACTGCTCAGGCATGTGATGAACCCTCTGGAAACCCTCAGCATTACCAATTGCAGACTGTCCGAGGGAGACGTCATGCATCTGTCC

MAGE-1 #19
R  A  L  A  E  T  S  Y  V  K  V  L  E  Y  V  I  K  V  S  A  R  V  R  F  F  F  P  S  L  R
AGGGCTCTGGCTGAGACAAGCTATGTGAAAGTGCTCGAGTATGTGATTAAGGTCAGCGCTAGGGTCAGGTTTTTCTTTCCCTCCCTGAGA

PRAME #30
S  N  L  T  H  V  L  Y  P  V  P  L  E  S  Y  E  D  I  H  G  T  L  H  L  E  R  L  A  Y  L
AGCAATCTGACACACGTCCTGTATCCCGTCCCCCTCGAGTCCTACGAAGACATTCACGGAACCCTCCACCTCGAGAGACTGGCTTACCTC

NYNSO1b #1
A  A  M  L  M  A  Q  E  A  L  A  F  L  M  A  Q  G  A  M  L  A  A  Q  E  R  R  V  P  R  A
GCCGCTATGCTCATGGCTCAGGAAGCCCTCGCCTTTCTGATGGCCCAAGGCGCTATGCTCGCCGCTCAGGAAAGGAGAGTGCCTAGGGCT

MAGE-1 #10
K  N  Y  K  H  C  F  P  E  I  F  G  K  A  S  E  S  L  Q  L  V  F  G  I  D  V  K  E  A  D
AAGAATTACAAACACTGTTTCCCTGAGATTTTCGGAAAGGCTAGCGAAAGCCTCCAGCTCGTGTTTGGCATTGACGTCAAGGAAGCCGAT

MAGE-3 #4
T  L  V  E  V  T  L  G  E  V  P  A  A  E  S  P  D  P  P  Q  S  P  Q  G  A  S  S  L  P  T
ACCCTCGTGGAAGTGACACTGGGAGAGGTCCCCGCTGCCGAAAGCCCTGACCCTCCCCAAAGCCCTCAGGGAGCCTCCAGCCTCCCCACA

PRAME #32
H  A  R  L  R  E  L  L  C  E  L  G  R  P  S  M  V  W  L  S  A  N  P  C  P  H  C  G  D  R
CACGCTAGGCTCAGGGAACTGCTCTGCGAACTGGGAAGGCCTAGCATGGTGTGGCTGTCCGCCAATCCCTGTCCCCATTGCGGAGACAGA

PRAME #25
V  M  L  T  D  V  S  P  E  P  L  Q  A  L  L  E  R  A  S  A  T  L  Q  D  L  V  F  D  E  C
GTGATGCTGACAGACGTCAGCCCTGAGCCTCTGCAAGCCCTCCTGGAAAGGGCTAGCGCTACCCTCCAGGATCTGGTCTTCGATGAGTGT

GAGE-1 #5
E  D  E  G  A  S  A  G  Q  G  P  K  P  E  A  D  S  Q  E  Q  G  H  P  Q  T  G  C  E  C  E
GAGGATGAGGGAGCCTCCGCCGGACAGGGACCCAAACCCGAAGCCGATAGCCAAGAGCAAGGCCATCCCCAAACCGGATGCGAATGCGAA

MAGE-3 #10
E  M  L  G  S  V  V  G  N  W  Q  Y  F  F  P  V  I  F  S  K  A  S  S  S  L  Q  L  V  F  G
GAGATGCTGGGAAGCGTCGTGGGAAACTGGCAGTATTTCTTTCCCGTCATCTTTAGCAAAGCCTCCAGCTCCCTGCAACTGGTCTTCGGA

GAGE-1 #1
A  A  M  S  W  R  G  R  S  T  Y  R  P  R  P  R  R  Y  V  E  P  P  E  M  I  G  P  M  R  P
GCCGCTATGTCCTGGAGAGGCAGAAGCACATACAGACCCAGACCCAGAAGGTATGTGGAACCCCCTGAGATGATCGGACCCATGAGGCCT

PRAME #2
Y  I  S  M  S  V  W  T  S  P  R  R  L  V  E  L  A  G  Q  S  L  L  K  D  E  A  L  A  I  A
TACATTAGCATGAGCGTCTGGACAAGCCCTAGGAGACTGGTCGAGCTCGCCGGACAGTCCCTGCTCAAGGATGAGGCTCTGGCTATCGCT

MAGE-1 #16
Y  D  G  R  E  H  S  A  Y  G  E  P  R  K  L  L  T  Q  D  L  V  Q  E  K  Y  L  E  Y  R  Q
TACGATGGCAGAGAGCATAGCGCTTACGGAGAGCCTAGGAAACTGCTCACCCAAGACCTCGTGCAAGAGAAATACCTCGAGTATAGGCAA

LAGE1 #12
Q  C  F  L  P  V  F  L  A  Q  A  P  S  G  Q  R  R  A  A
CAGTGTTTCCTCCCCGTCTTCCTCGCCCAAGCCCCTAGCGGACAGAGAAGGGCTGCC

Figure 27 (Cont)

MAGE-3 #20
V K V L H H M V K I S G G P H I S Y P P L H E W V L R E G E
GTGAAAGTGCTCCACCATATGGTCAAGATTAGCGGAGGCCCTCACATTAGCTATCCCCCTCTGCATGAGTGGGTGCTCAGGGAAGGCGAA

LAGE1 #7
Q L H I T M P F S S P M E A E L V R R I L S R D A A P L P R
CAGCTCCACATTACCATGCCCTTTAGCTCCCCCATGGAGGCTGAGCTCGTGAGAAGGATTCTGTCCAGGGATGCCGCTCCCCTCCCCAGA

NYNSO1a #9
P G V L L K E F T V S G N I L T I R L T A A D H R Q L Q L S
CCCGGAGTGCTCCTGAAAGAGTTTACCGTCAGCGGAAACATTCTGACAATCAGACTGACAGCCGCTGACCATAGGCAACTGCAACTGTCC

PRAME #16
K M I L K M V Q L D S I E D L E V T C T W K L P T L A K F S
AAGATGATCCTCAAGATGGTGCAACTGGATAGCATTGAGGATCTGGAAGTGACATGCACATGGAAACTGCCTACCCTCGCCAAATTCTCC

MAGE-1 #14
F L I I V L V M I A M E G G H A P E E E I W E E L S V M E V
TTCCTCATCATTGTGCTCGTGATGATCGCTATGGAAGGCGGACACGCTCCCGAAGAGGAAATCTGGGAGGAACTGTCCGTGATGGAGGTC

PRAME #17
E V T C T W K L P T L A K F S P Y L G Q M I N L R R L L L S
GAGGTCACCTGTACCTGGAAGCTCCCCACACTGGCTAAGTTTAGCCCTTACCTCGGCCAAATGATTAACCTCAGGAGACTGCTCCTGTCC

MAGE-3 #2
E G L E A R G E A L G L V G A Q A P A T E E Q E A A S S S S
GAGGGACTGGAAGCCAGAGGCGAAGCCCTCGGCCTCGTGGGAGCCCAAGCCCCTGCCACAGAGGAACAGGAAGCCGCTAGCTCCAGCTCC

MAGE-3 #21
I S Y P P L H E W V L R E G E E A A
ATCTCCTACCCTCCCCTCCACGAATGGGTCCTGAGAGAGGGAGAGGAAGCCGCT

PRAME #19
H I H A S S Y I S P E K E E Q Y I A Q F T S Q F L S L Q C L
CACATTCACGCTAGCTCCTACATTAGCCCTGAGAAAGAGGAACAGTATATCGCTCAGTTTACCTCCCAGTTTCTGTCCCTGCAATGCCTC

NYNSO1a #3
G N A G G P G E A G A T G G R G P R G A G A A R A S G P G G
GGCAATGCCGGAGGCCCTGGCGAAGCCGGAGCCACAGGCGGAAGGGGACCCAGAGGCGCTGGCGCTGCCAGAGCCTCCGGCCCTGGCGGA

NYNSO1a #4
G P R G A G A A R A S G P G G G A P R G P H G G A A S G L N
GGCCCTAGGGGAGCCGGAGCCGCTAGGGCTAGCGGACCCGGAGGCGGAGCCCCTAGGGGACCCCATGGCGGAGCCGCTAGCGGACTGAAT

MAGE-1 #5
Q G A S A F P T T I N F T R Q R Q P S E G S S S R E E E G P
CAGGGAGCCTCCGCCTTTCCCACAACCATTAACTTTACCAGACAGAGACAGCCTAGCGAAGGCTCCAGCTCCAGGGAAGAGGAAGGCCCT

NYNSO1a #8
L A R R S L A Q D A P P L P V P G V L L K E F T V S G N I L
CTGGCTAGGAGAAGCCTCGCCCAAGACGCTCCCCCTCTGCCTGTGCCTGGCGTCCTGCTCAAGGAATTCACAGTGTCCGGCAATATCCTC

PRAME #5
A A F D G R H S Q T L K A M V Q A W P F T C L P L G V L M K
GCCGCTTTCGATGGCAGACACTCCCAGACACTGAAAGCCATGGTGCAAGCCTGGCCCTTTACCTGTCTGCCTCTGGGAGTGCTCATGAAA

MAGE-1 #20
I K V S A R V R F F F P S L R E A A L R E E E E G V A A
ATCAAAGTGTCCGCCAGAGTGAGATTCTTTTTTCCCTAGCCTCAGGGAAGCCGCTCTGAGAGAGGAAGAGGAAGGCGTCGCCGCT

PRAME #27
G I T D D Q L L A L L P S L S H C S Q L T T L S F Y G N S I
GGCATTACCGATGACCAACTGCTCGCCCTCCTGCCTAGCCTCAGCCATTGCTCCCAGCTCACCACACTGTCCTTCTATGGCAATAGCATT

GAGE-1 #8
V K T P E E E M R S H Y V A Q T G I L W L L M N N C F L N L
GTGAAAACCCCTGAGGAAGAGATGAGGTCCCACTATGTGGCTCAGACAGGCATTCTGTGGCTGCTCATGAATAACTGTTTCCTCAACCTC

LAGE1 #11
I S S C L Q Q L S L L M W I T Q C F L P V F L A Q A P S G Q
ATCTCCAGCTGTCTGCAACAGCTCAGCCTCCTGATGTGGATTACCCAATGCTTTCTGCCTGTGTTTCTGGCTCAGGCTCCCTCCGGCCAA

Figure 27 (Cont)

PRAME #14
Y L I E K V K R K K N V L R L C C K K L K I F A M P M Q D I
TACCTCATCGAAAAGGTCAAGAGAAAGAAAAACGTCCTGAGACTGTGTTGCAAAAAGCTCAAGATTTTCGCTATGCCTATGCAAGACATT

MAGE-1 #9
A R E P V T K A E M L E S V I K N Y K H C F P E I F G K A S
GCCAGAGAGCCTGTGACAAAGGCTGAGATGCTGGAAAGCGTCATCAAAAACTATAAGCATTGCTTTCCCGAAATCTTTGGCAAAGCCTCC

LAGE1 #8
L V R R I L S R D A A P L P R P G A V L K D F T V S G N L L
CTGGTCAGGAGAATCCTCAGCAGAGACGCTGCCCCTCTGCCTAGGCCTGGCGCTGTGCTCAAGGATTTCACAGTGTCCGGCAATCTGCTC

PRAME #28
H C S Q L T T L S F Y G N S I S I S A L Q S L L Q H L I G L
CACTGTAGCCAACTGACAACCCTCAGCTTTTACGGAAACTCCATCTCCATCTCCGCCCTCCAGTCCCTGCTCCAGCATCTGATTGGCCTC

PRAME #33
M V W L S A N P C P H C G D R T F Y D P E P I L C P C F M P
ATGGTCTGGCTCAGCGCTAACCCTTGCCCTCACTGTGGCGATAGGACATTCTATGACCCTGAGCCTATCCTCTGCCCTTGCTTTATGCCT gp100In4 #1
A A S W S Q K R S F V Y V W K T W G E G L P S Q P I I H T C
GCCGCTAGCTGGAGCCAAAAGAGAAGCTTTGTGTATGTGTGGAAGACATGGGGAGAGGGACTGCCTAGCCAACCCATTATCCATACCTGT

BAGE #2
L L Q A R L M K E E S P V V S W R L E P E D G T A L C F I F
CTGCTCCAGGCTAGGCTCATGAAAGAGGAAAGCCCTGTGGTCAGCTGGAGGCTCGAGCCTGAGGATGGCACAGCCCTCTGCTTTATCTTT gp100In4 #3
V Y F F L P D H L S F G R P F H L N F C D F L A A
GTGTATTTCTTTCTGCCTGACCATCTGTCCTTCGGAAGGCCTTTCCATCTGAATTTCTGTGACTTTCTGGCTGCC

PRAME #18
P Y L G Q M I N L R R L L L S H I H A S S Y I S P E K E E Q
CCCTATCTGGGACAGATGATCAATCTGAGAAGGCTCCTGCTCAGCCATATCCATGCCTCCAGCTATATCTCCCCCGAAAAGGAAGAGCAA

MAGE-3 #3
Q A P A T E E Q E A A S S S S T L V E V T L G E V P A A E S
CAGGCTCCCGCTACCGAAGAGCAAGAGGCTGCCTCCAGCTCCAGCACACTGGTCGAGGTCACCCTCGGCGAAGTGCCTGCCGCTGAGTCC

PRAME #6
Q A W P F T C L P L G V L M K G Q H L H L E T F K A V L D G
CAGGCTTGGCCTTTCACATGCCTCCCCCTCGGCGTCCTGATGAAGGGACAGCATCTGCATCTGGAAACCTTTAAGGCTGTGCTCGACGGA

PRAME #12
L S T E A E Q P F I P V E V L V D L F L K E G A C D E L F S
CTGTCCACCGAAGCCGAACAGCCTTTCATTCCCGTCGAGGTCCTGGTCGACCTCTTCCTCAAGGAAGGCGCTTGCGATGAGCTCTTCTCC

NYNSO1b #3
A E V P G A Q G Q Q G P R G R E E A P R G V R M A A R L Q G
GCCGAAGTGCCTGGCGCTCAGGGACAGCAAGGCCCTAGGGGAAGGGAAGAGGCTCCCAGAGGCGTCAGGATGGCCGCTAGGCTCCAGGGA

LAGE1 #5
G A P R G P H G G A A S A Q D G R C P C G A R R P D S R L L
GGCGCTCCCAGAGGCCCTCACGGAGGCGCTGCCTCCGCCCAAGACGGAAGGTGTCCCTGTGGCGCTAGGAGACCCGATAGCAGACTGCTC

LAGE1 #4
G P R G A G A A R A S G P R G G A P R G P H G G A A S A Q D
GGCCCTAGGGGAGCCGGAGCCGCTAGGGCTAGCGGACCCAGAGGCGGAGCCCCTAGGGGACCCCATGGCGGAGCCGCTAGCGCTCAGGAT

PRAME #3
L A G Q S L L K D E A L A I A A L E L L P R E L F P P L F M
CTGGCTGGCCAAAGCCTCCTGAAAGACGAAGCCCTCGCCATTGCCGCTCTGGAACTGCTCCCCAGAGAGCTCTTCCCTCCCCTCTTCATG

GAGE-1 #4
E P A T Q R Q D P A A A Q E G E D E G A S A G Q G P K P E A
GAGCCTGCCACACAGAGACAGGATCCCGCTGCCGCTCAGGAAGGCGAAGACGAAGGCGCTAGCGCTGGCCAAGGCCCTAAGCCTGAGGCT

PRAME #11
P E A A Q P M T K K R K V D G L S T E A E Q P F I P V E V L
CCCGAAGCCGCTCAGCCTATGACAAAGAAAAGGAAAGTGGATGGCCTCAGCACAGAGGCTGAGCAACCCTTTATCCCTGTGGAAGTGCTC

Figure 27 (Cont)

```
LAGE1 #6
  G   R   C   P   C   G   A   R   R   R   P   D   S   R   L   L   Q   L   H   I   T   M   P   F   S   S   P   M   E   A   E
GGCAGATGCCCTTGCGGAGCCAGAAGGCCTGACTCCAGGCTCCTGCAACTGCATATCACAATGCCTTTCTCCAGCCCTATGGAAGCCGAA

LAGE1 #9
  P   G   A   V   L   K   D   F   T   V   S   G   N   L   L   F   I   R   L   T   A   A   D   H   R   Q   L   Q   L   S
CCCGGAGCCGTCCTGAAAGACTTTACCGTCAGCGGAAACCTCCTGTTTATCAGACTGACAGCCGCTGACCATAGGCAACTGCAACTGTCC

PRAME #31
  E   D   I   H   G   T   L   H   L   E   R   L   A   Y   L   H   A   R   L   R   E   L   L   C   E   L   G   R   P   S
GAGGATATCCATGGCACACTGCATCTGGAAAGGCTCGCCTATCTGCATGCCAGACTGAGAGAGCTCCTGTGTGAGCTCGGCAGACCCTCC

GAGE-1 #6
  D   S   Q   E   Q   G   H   P   Q   T   G   C   E   C   E   D   G   P   D   G   Q   E   M   D   P   P   N   P   E   E
GACTCCCAGGAACAGGGACACCCTCAGACAGGCTGTGAGTGTGAGGATGGCCCTGACGGACAGGAAATGGATCCCCCTAACCCTGAGGAA

TRP2IN2 #3
  F   V   I   G   L   R   V   W   Q   W   E   V   I   S   C   K   L   I   K   R   A   T   T   R   Q   P   A   A
TTCGTCATCGGACTGAGAGTGTGGCAGTGGGAGGTCATCTCCTGCAAACTGATTAAGAGAGCCACAACCAGACAGCCTGCCGCT

LAGE1 #2
  D   A   D   G   P   G   G   P   G   I   P   D   G   P   G   G   N   A   G   G   P   G   E   A   G   A   T   G   G   R
GACGCTGACGGACCCGGAGGCCCTGGCATTCCCGATGGCCCTGGCGGAAACGCTGGCGGACCCGGAGAGGCTGGCGCTACCGGAGGCAGA

MAGE-1 #12
  P   T   G   H   S   Y   V   L   V   T   C   L   G   L   S   Y   D   G   L   L   G   D   N   Q   I   M   P   K   T   G
CCCACAGGCCATAGCTATGTGCTCGTGACATGCCTCGGCCTCAGCTATGACGGACTGCTCGGCGATAACCAAATCATGCCCAAAACCGGA

MAGE-3 #9
  F   L   L   L   K   Y   R   A   R   E   P   V   T   K   A   E   M   L   G   S   V   V   G   N   W   Q   Y   F   F   P
TTCCTCCTGCTCAAGTATAGGGCTAGGGAACCCGTCACCAAAGCCGAAATGCTCGGCTCCGTGGTCGGCAATTGGCAATACTTTTTCCCT

GAGE-1 #9
  T   G   I   L   W   L   L   M   N   N   C   F   L   N   L   S   P   R   K   P   A   A
ACCGGAATCCTCTGGCTCCTGATGAACAATTGCTTTCTGAATCTGTCCCCCAGAAAGCCTGCCGCT

MAGE-3 #8
  E   F   Q   A   A   L   S   R   K   V   A   E   L   V   H   F   L   L   L   K   Y   R   A   R   E   P   V   T   K   A
GAGTTTCAGGCTGCCCTCAGCAGAAAGGTCGCCGAACTGGTCCACTTTCTGCTCCTGAAATACAGAGCCAGAGAGCCTGTGACAAAGGCT

MAGE-1 #18
  V   P   D   S   D   P   A   R   Y   E   F   L   W   G   P   R   A   L   A   E   T   S   Y   V   K   V   L   E   Y   V
GTGCCTGACTCCGACCCTGCCAGATACGAATTCCTCTGGGGACCCAGAGCCCTCGCCGAAACCTCCTACGTCAAGGTCCTGGAATACGTC

NYNS01a #6
  G   C   C   R   C   G   A   R   G   P   E   S   R   L   L   E   F   Y   L   A   M   P   F   A   T   P   M   E   A   E
GGCTGTTGCAGATGCGGAGCCAGAGGCCCTGAGTCCAGGCTCCTGGAATTCTATCTGGCTATGCCTTTCGCTACCCCTATGGAAGCCGAA

MAGE-3 #13
  A   T   C   L   G   L   S   Y   D   G   L   L   G   D   N   Q   I   M   P   K   A   G   L   L   I   I   V   L   A   I
GCCACATGCCTCGGCCTCAGCTATGACGGACTGCTCGGCGATAACCAAATCATGCCCAAAGCCGGACTGCTCATCATTGTGCTCGCCATT

LAGE1 #3
  G   N   A   G   G   P   G   E   A   G   A   T   G   G   R   G   P   R   G   A   G   A   A   R   A   S   G   P   R   G
GGCAATGCCGGAGGCCCTGGCGAAGCCGGAGCCACAGGCGGAAGGGGACCCAGAGGCGCTGGCGCTGCCAGAGCCTCCGGCCCTAGGGGA

Artificial Protein:
-------------------
APEEEIWEELSVMEVYDGREHSAYGEPRKLEEVPTAGSTDPPQSPQGASAFPTTINFTRQTVWSGNRASLYSFPEPEAAQPMTKKRKVDGQIMPKAGL
LIIVLAIIAREGDCAPEEKIWELQVLDLRKNSHQDFWTVWSGNRASLYSFPELDVLLAQEVRPRRWKLQVLDLRKNSHQDFWQGAMLAAQERRVPRAA
EVPGAQGQQGPRGRQSPSVSQLSVLSLSGVMLTDVSPEPLQALLLTQDLVQEKYLEYRQVPDSDPARYEFLWGPRQPSEGSSSREEEGPSTSCILESL
FRAVITAAMAARAVFLALSAQLLQARLMKEESPVVSTFYDPEPILCPCFMPNAAIELMEVDPIGHLYIFATCLGLSYDGLLGDNRRYVEPPEMIGPMR
PEQFSDEVEPATPEEGEAGGFFPWLKVYYYRFVIGLRVWQWEVISCAAMERRRLWGSIQSRYISMSVWTSPRRLVEAALMETHLSSKRYTEEAGGFFP
WLKVYYYRAAMSLEQRSLHCKPEEALEAQQEALGLVCVQAATSSSSPLVLGTLEEVPTAGSTDPPQSPALELLPRELFPPLFMAAFDGRHSQTLKAMV
ELSVLEVFEGREDSILGDPKKLLTQHFVQEESLQLVFGIDVKEADPTGHSYVLVTCLGLSPDDPPQSPQGASSLPTTMNYPLWSQSYEDSSAAMQAEGQ
GTGGSTGDADGPGGPGIPDGPGQCFLPVFLAQPPSGQRRAATWGEGLPSQPIIHTCVYFFLPDHLSFGRPFSTSCILESLFRAVITKKVADLVGFLLL
KYRAAMQAEGRGTGGSTGDADGPGGPGIPDGPGDGPDGQEMDPPNPEEVKTPEEEMRSHYVAQISSCLQQLSLLMWITQCFLPVFLAQPPSGQERASA
TLQDLVFDECGITDDQLLALLPSLSLGDPKKLLTQHFVQENYLEYRQVPGSDPACEALEAQQEALGLVCVQAATSSSSPLVLGTLEFYLAMPFATPME
AELARRSLAQDAPPLPVEEAPRGVRMAARLQGAAWRLEPEDGTALCFIFAAEQFSDEVEPATPEEGEPATQRQDPAAAQEGTMNYPLWSQSYEDSSNQ
EEEGPSTFPDLESNQEEEGPSTFPDLESEFQAALSRKVAELVHVDLFLKEGACDELFSYLIEKVKRKKNVLRLTIRLTAADHRQLQLSISSCLQQLSL
LMWITAAMPLEQRSQHCKPEEGLEARGEALGLVGADADGPGGPGIPDGPGGNAGGPGEAGATGGRYEFLWGPRALVETSYVKVLHHMVKISGGPHITN
CRLSEGDVMHLSQSPSVSQLSVLSLSGNYLEYRQVPGSDPACYEFLWGPRALVETSYVIFSKASSSLQLVFGIELMEVDPIGHLYIFQALYVDSLFFL
```

Figure 27 (Cont)

```
RGRLDQLLRHVMNPLETLSYIAQFTSQFLSLQCLQALYVDSLFFLRGRLGQHLHLETFKAVLDGLDVLLAQEVRPRRWKFIRLTAADHRQLQLSISSC
LQQLSLLMWITCCKKLKIFAMPMQDIKMILKMVQLDSIEDLGAPRGPHGGAASGLNGCCRCGARGPESRLLKKVADLVGFLLLKYRAREPVTKAEMLE
SVIYDGLLGDNQIMPKTGFLIIVLVMIAMEGGHSISALQSLLQHLIGLSNLTHVLYPVPLESYIAREGDCAPEEKIWEELSVLEVFEGREDSIDQLLR
HVMNPLETLSITNCRLSEGDVMHLSRALAETSYVKVLEYVIKVSARVRFFFPSLRSNLTHVLYPVPLESYEDIHGTLHLERLAYLAAMLMAQEALAFL
MAQGAMLAAQERRVPRAKNYKHCFPEIFGKASESLQLVFGIDVKEADTLVEVTLGEVPAAESPDPPQSPQGASSLPTHARLRELLCELGRPSMVWLSA
NPCPHCGDRVMLTDVSPEPLQALLERASATLQDLVFDECEDEGASAGQGPKPEADSQEQGHPQTGCECEEMLGSVVGNWQYFFPVIFSKASSSLQLVF
GAAMSWRGRSTYRPRPRRYVEPPEMIGPMRPYISMSVWTSPRRLVELAGQSLLKDEALAIAYDGREHSAYGEPRKLLTQDLVQEKYLEYRQQCFLPVF
LAQAPSGQRRAAVKVLHHMVKISGGPHISYPPLHEWVLREGEQLHITMPFSSPMEAELVRRILSRDAAPLPRPGVLLKEFTVSGNILTIRLTAADHRQ
LQLSKMILKMVQLDSIEDLEVTCTWKLPTLAKFSFLIIVLVMIAMEGGHAPEEEIWEELSVMEVEVTCTWKLPTLAKFSPYLGQMINLRRLLLSEGLE
ARGEBALGLVGAQAPATEEQEAASSSSISYPPLHEWVLREGEEAAHIHASSYISPEKEEQYIAQFTSQFLSLQCLGNAGGPGEAGATGGRGPRGAGAAR
ASGPGGGPRGAGAARASGPGGGAPRGPHGGAASGLNQGASAFPTTINFTRQRQPSEGSSSREEEGPLARRSLAQDAPPLPVPGVLLKEFTVSGNILAA
FDGRHSQTLKAMVQAWPFTCLPLGVLMKIKVSARVRFFFPSLREAALREEEEGVAAGITDDQLLALLPSLSHCSQLTTLSFYGNSIVKTPEEEMRSHY
VAQTGILWLLMNNCFLNLISSCLQQLSLLMWITQCFLPVFLAQAPSGQYLIEKVKRKKNVLRLCCKKLKIFAMPMQDIAREPVTKAEMLESVIKNYKH
CFPEIFGKASLVRRILSRDAAPLPRPGAVLKDFTVSGNLLHCSQLTTLSFYGNSISISALQSLLQHLIGLMVWLSANPCPHCGDRTFYDPEPILCPCF
MPAASWSQKRSFVYVWKTWGEGLPSQPIIHTCLLQARLMKEESPVVSWRLEPEDGTALCFIFVYFFLPDHLSFGRPFHLNFCDFLAAPYLGQMINLRR
LLLSHIHASSYISPEKEEQQAPATEEQEAASSSSTLVEVTLGEVPAAESQAWPFTCLPLGVLMKGQHLHLETFKAVLDGLSTEAEQPFIPVEVLVDLF
LKEGACDELFSAEVPGAQGQQGPRGREEAPRGVRMAARLQGGAPRGPHGGAASAQDGRCPCGARRPDSRLLGPRGAGAARASGPRGGAPRGPHGGAAS
AQDLAGQSLLKDEALAIAALELLPRELFPPLFMEPATQRQDPAAAQEGEDEGASAGQGPKPEAPEAAQPMTKKRKVDGLSTEAEQPFIPVEVLGRCPC
GARRPDSRLLQLHITMPFSSPMEAEPGAVLKDFTVSGNLLFIRLTAADHRQLQLSEDIHGTLHLERLAYLHARLRELLCELGRPSDSQEQGHPQTGCE
CEDGPDGQEMDPPNPEEFVIGLRVWQWEVISCKLIKRATTRQPAADADGPGGPGIPDGPGGNAGGPGEAGATGGRPTGHSYVLVTCLGLSYDGLLGDN
QIMPKTGFLLLKYRAREPVTKAEMLGSVVGNWQYFFPTGILWLLMNNCFLNLSPRKPAAEFQAALSRKVAELVHFLLLKYRAREPVTKAVPDSDPARY
EFLWGPRALAETSYVKVLEYVGCCRCGARGPESRLLEFYLAMPFATPMEAEATCLGLSYDGLLGDNQIMPKAGLLIIVLAIGNAGGPGEAGATGGRGP
RGAGAARASGPRG

Artificial DNA:
---------------
GCCCCTGAGGAAGAGATTTGGGAAGAGCTCAGCGTCATGGAAGTGTATGACGGAAGGGAACACTCCGCCTATGGCGAACCCAGAAAGCTCGAGGAAGT
GCCTACCGCTGGCTCCACCGATCCCCCTCAGTCCCCCCAAGGCGCTAGCGCTTTCCCTACCACAATCAATTTCACAAGGCAAACCGTCTGGTCCGGCA
ATAGGGCTAGCCTCTACTCCTTCCCTGAGCCTGAGGCTGCCCAACCCATGACCAAAAAGAGAAAGGTCGACGGACAGATTATGCCTAAGGCTGGCCTC
CTGATTATCGTCCTGGCTATCATTGCCAGAGAGGGAGACTGTGACCCCTGAGGAAAAGATTTGGGAACTGCAAGTGCTCGACCTCAGGAAAAACTCCCA
CCAAGACTTTTGGACAGTGTGGAGCGGAAACAGAGCCTCCCTGTATAGCTTTCCCGAACTGGATGTGCTCCTGGCTCAGGAAGTGAGACCCAGAAGGT
GGAAGCTCCAGGTCCTGGATCTGAGAAAGAATAGCCATCAGGATTTCTGGCAGGGAGCCATGCTGGCTGCCCAAGAGAGAAGGGTCCCCAAGAGCCGCT
GAGGTCCCCGGAGCCCAAGGCCAACAGGGACCCAGAGGCAGACAGTCCCCCTCCGTGTCCCAGCTCAGCGTCCTGTCCCTGTCCGGCGTCATGCTCAC
CGATGTGTCCCCCGAACCCCTCCAGGCTCTGCTCCTGACACAGGATCTGGTCCAGGAAAAGTATCTGGAATACAGACAGGTCCCCGATAGCGATCCCG
CTAGGTATGAGTTTCTGTGGGGCCCTAGGCAACCCTCCGAGGGAAGCTCCAGCAGAGAGGAAGAGGGACCCTCCACCTCCTGCATTCTGGAAAGCCTC
TTCAGAGCCGTCATCACAGCCGCTATGGCTGCCGAGCCGTCTTCCTCGCCCTCAGCGCTCAGCTCCTGCAAGCCAGACTGATGAAGGAAGAGTCCCC
CGTCGTGTCCACCTTTTACGATCCCGAACCCATTCGTGTCCCTGTTTCATGCCCAATGCCGCTATCGAACTGATGGAGGTCGACCCTATCGGACACC
TCTACATTTTCGCTACCTGTCTGGGACTGTCCTACGATGGCCTCCTGGGAGACAATAGGAGATACGTCGAGCCTCCCGAAATGATTGGCCCTATGAGA
CCCGAACAGTTTAGCGATGAGGTCGAGCCTGCCACACCCGAAGAGGGAGAGGCTGGCGGATTCTTTCCCTGGCTGAAAGTGTATTACTATAGGTTTGT
GATTGGCCTCAGGGTCTGGCAATGGGAAGTGATTAGCTGTGCGCTATGTGGAAAGGAGAAGGCTCTCAGGGGTATATCTCCATGT
CCGTGTGGACCTCCCCCAGAAGGCTCGTGGAAGCCGCTCTGATGGAGACACACCTCAGCTCCAAGAGATACACAGAGGAAGCCGGAGGCTTTTTCCCT
TGGCTCAAGGTCTACTATTACAGAGCCGCTATGTCCCTGGAACAGAGAAGCCTCCACTGTAAGCCTGAGGAAGCCCTCGAGGCTCAGCAAGAGGCTCT
GGGACTGGTCTGCGTCCAGGCTGCCACAAGCTCCAGCTCCCCCTCGTGCTCGGCACACTGGAAGAGGTCCCCACAGCCGGAAGCACAGACCCTCCCC
AAAGCCCTGCCCTCGAGCTCCTGCCTAGGGAACTGTTTCCCCTCTGTTTATGGCTGCCTTTGACGGAAGGCATAGCCAAACCCTCAAGGCTATGGTC
GAGCTCAGCGTCCTGGAAGTGTTTGAGGGAAGGGAAGACTCCATCCTCGGCGATCCCAAAAAGCTCCTGACACAGCATTTCGTCCAGGAAGAGTCCCT
GCAACTGGTCTTCGGAATCGATGTGAAAGAGGCTGACCCTACCGGACACTCCTACGTCCTGGTCACCTGTCTGGGACTGTCCCCCGATCCCCCTCAGT
CCCCCCAAGGCGCTAGCTCCCTGCCTACCACAATGAATTACCCTCTGTGGAGCCAAGACTATGAGGATAGCTCCGCCGCTATGCAAGCCGAAGGCCAA
GGCACAGGCGGAAGCACAGGCGATGCCGATGGCCCTGGCGGACCCGGAATCCCTGACGGACCCGGACAGTGTTTCCTCCCCGTCTTCCTCGCCCAACC
CCCTAGCGGACAGAGAAGGGCTGCCACCTGGGGCGAAGGCCTCCCCTCCCAGCCTATCATTCACACATGCGTCTACTTTTCCTCCCCGATCACCTCA
GCTTTGGCAGACCCTTTAGCACAAGCTGTATCCTCGAGTCCCTGTTTAGGGCTGTGATTACCAAAAAGGTCGCCGATCTGGTCGGCTTTCTGCTCCTG
AAATACAGAGCCGCTATGCAAGCCGAAGCCAGAGGCACAGGCGAAGCACAGGCGATGCCGATGGCCCTGGCGGACCCGGAATCCCTGACGGACCCGG
AGACGGACCCGATGGCCAAGAGATGGACCCTCCCAATCCCGAAGAGGTCAAGACACCCGAAGAGGAAATGAGAAGCCATTACGTCGCCCAAATCTCCA
GCTGTCTGCAACAGCTCAGCCTCCTGATGTGGATTACCCAATGCTTTCTGCCCTGTGTTTCTGGCTCAGCCTCCCTCCGGCCAAGAGAGAGCCTCCGCC
ACACTGCAAGACCTCGTGTTTGACGAATGCGGAATCACAGACGATCAGCTCCTGGCTCTGCTCCCCTCCCTGTCCCTGGGAGACCCTAAGAAACTGCT
CACCCAACACTTTGTGCAAGAGAATTACCTCGAGTATAGGCAAGTGCCTGGCTCCAGGCCTGTGAGGCTCTGGAAGCCCAACAGGAAGCCCTCG
GCCTCGTGTGTGTGCAAGCCGCTACCTCCAGCTCCAGCCCTCTGGTCCTGGGAACCCTCGAGTTTACCTCGCCATGCCCTTTGCCACACCCATGGAG
GCTGAGCTCGCCAGAAGGTCCCTGGCTCAGGATGCCCCTCCCCTCCCCGTCGAGGAAGCCCCTAGGGGAGTGAGAATGGCTGCCAGACTGCAAGGCGC
TGCCTGGAGACTGGAACCCGAAGACGGAACCGCTCTGTGTTTCATTTTCGCTGCCGAGCAATTCTCCGACGAAGTGGAACCCGCTACCCCTGAGGAAG
GCGAACCCGCTACCCAAAGGCAAGACCCTGCCGCTGCCCAAGAGGGAACCATGAACTATCCCCTCTGGTCCCAGTCCTACGAAGACTCCAGCAATCAG
GAAGAGGAAGGCCCCTAGCACATTCCCTGACCTCGAGTCCAACCAAGAGGAAGAGGGACCCTCCACCTTTCCCGATCTGGAAAGCGAATTCCAAGCCGC
TCTGTCCAGGAAAGTGGCTGAGCTCGTCATGTGGATCTGTTTCTGAAAGAGGGAGCCTGTGACGAACTGTTTAGCTATCTGATTGAGAAAGTGAAAA
GGAAAAAGAATGTGCTCAGGCTCACCATTAGGCTCACCGCTGCCGATCACAGACAGCTCCAGCTCAGCATTAGCTCCTGCCTCCAGCAACTGTCCCTG
CTCATGTGGATCACAGCCGCTATGCCTCTGGAACAGAGAAGCCAACACTGTAAGCCTGAGGAAGGCCTCGAGGCTAGGGGAGAGGCTCTGGGACTGGT
CGGCGCTGACGCTGACGGACCCGGAGGCCCTGGCATTCCCGATGGCCCTGGCGGAAACGCTGGCGGACCCGGAGAGGCTGGCGCTACCGGAGGCAGAT
ACGAATTCCTCTGGGGACCCAGAGCCCTCGTGAAACCTCCTACGTCAAGGTCCTGCATCACATGGTGAAAATCTCCGGCGGACCCCATATCACAAAC
TGTAGGCTCAGCGAAGGCGATGTGATGCACCTCAGCCAAAGCCCTAGCGTCAGCCCTAGGGCTCTGGTCGAGACAAGCTATGTGATTTTCTCAAGGCTAGCTCCA
ACAGGTCCCCGGAAGCGATCCCGCTTGCTATGAGTTTCTGTGGGGCCCTAGGGCTCTGGTCGAGACAAGCTATGTGATTTTCTCAAGGCTAGCTCCA
GCCTCCAGCTCGTGTTTGGCATTGAGCTCATGGAAGTGGATCCCATTGGCCATCGTATATCTTTCAGGCTCTGTATGTGGATAGCCTCTTCTTTCTG
AGAGGCAGACTGGATCAGCTCCTGAGACACGTCATGAATCCCCTCGAGACACTGTCCTACATTGCCCAATTCACAAGCCAATTCCTCAGCCTCCAGTG
TCTGCAAGCCCTCTACGTCGACTCCCTGTTTTTCCTCAGGGGAAGGCTCGGCCAACACCTCCACCTCGAGACATTCAAAGCCGTCCTGGATGCCTCG
ACGTCCTGCTCGCCCAAGAGGTCAGGCCTAGGAGATGGAAATTCATTAGGCTCCACCGCTGCCGATCACAGACAGCTCCAGCTCAGCATTAGCTCCTGC
CTCCAGCAACTGTCCCTGCTCATGTGGATCACATGCTGTAAGAAACTGAAATCTTTGCCATGCCCATGCAGGATATCAAAATGATTCTGAAAATGGT
```

Figure 27 (Cont)

```
CCAGCTCGACTCCATCGAAGACCTCGGCGCTCCCAGAGGCCCTCACGGAGGCGCTGCCTCCGGCCTCAACGGATGCTGTAGGTGTGGCGCTAGGGGAC
CCGAAAGCAGACTGCTCAAGAAAGTGGCTGACCTCGTGGGATTCCTCCTGCTCAAGTATAGGGCTAGGGAACCCGTCACCAAAGCCGAAATGCTCGAG
TCCGTGATTTACGATGGCCTCCTGGGAGACAATCAGATTATGCCTAAGACAGGCTTTCTGATTATCGTCCTGGTCATGATTGCCATGGAGGGAGGCCA
TAGCATTAGCGCTCTGCAAAGCCTCCTGCAACACCTCATCGGACTGTCCAACCTCACCCATGTGCTCTACCCTGTGCCTCTGGAAAGCTATATCGCTA
GGGAAGGCGATTGCGCTCCCGAAGAGAAAATCTGGGAGGAACTGTCCGTGCTCGAGGTCTTCGAAGGCAGAGAGGATAGCATTGACCAACTGCTCAGG
CATGTGATGAACCCTCTGGAAACCCTCAGCATTACCAATTGCAGACTGTCCGAGGGAGACGTCATGCATCTGTCCAGGGCTCTGGCTGAGACAAGCTA
TGTGAAAGTGCTCGAGTATGTGATTAAGGTCAGCGCTAGGGTCAGGTTTTTCTTTCCCTCCCTGAGAAGCAATCTGACACACGTCCTGTATCCCGTCC
CCCTCGAGTCCTACGAAGACATTCACGGAACCCTCCACCTCGAGAGACTGGCTTACCTCGCCGCTATGCTCATGGCTCAGGAAGCCCTCGCCTTTCTG
ATGGCCCAAGGCGCTATGCTCGCCGCTCAGGAAAGGAGAGTGCCTAGGGCTAAGAATTACAAACACTGTTTCCCTGAGATTTTCGGAAAGGCTAGCGA
AAGCCTCCAGCTCGTGTTTGGCATTGACGTCAAGGAAGCCGATACCCTCGTGGAAGTGACACTGGGAGAGGTCCCCGCTGCCGAAAGCCCTGACCCTC
CCCAAAGCCCTCAGGGAGCCTCCAGCCTCCCCACACACGCTAGGCTCAGGGAACTGCTCTGCGAACTGGGGAAGGCCTAGCATGGTGTGGCTGTCCGCC
AATCCCTGTCCCCATTGCGGAGACAGAGTGATGCTGACAGACGTCAGCCCTGAGCCTCTGCAAGCCCTCCTGGAAAGGGCTAGCGCTACCCTCCAGGA
TCTGGTCTTCGATGAGTGTGAGGATGAGGGAGCCTCCGCCGGACAGGGACCCAAACCCGAAGCCGATAGCCAAGAGCAAGGCCATCCCCAAACCGGAT
GCGAATGCGAAGAGATGCTGGGAAGCGTCGTGGGAAACTGGCAGTATTTCTTTCCCGTCATCTTTAGCAAAGCCTCCAGCTCCCTGCAACTGGTCTTC
GGAGCCGCTATGTCCTGGAGAGGCAGAAGCACATACAGACCCAGACCCAGAAGGTATGTGGAACCCCCTGAGATGATCGGACCCCATGAGGCCTTACAT
TAGCATGAGCGTCTGGACAAGCCCTAGGAGACTGGTCGAGCTCGCCGGACAGTCCCTGCTCAAGGATGAGGCTCTGGCTATCGCTTACGATGGCAGAG
AGCATAGCGCTTACGGAGAGCCTAGGAAACTGCTCACCCAAGACCTCGTGCAAGAGAAATACCTCGAGTATAGGCAACAGTGTTTCCTCCCCGTCTTC
CTCGCCCAAGCCCCTAGCGGACAGAGAAGGGCTGCCGTGAAAGTGCTCCACCATATGGTCAAGATTAGCGGAGGCCCTCACATTAGCTATCCCCCTCT
GCATGAGTGGGTGCTCAGGGAAGGCGAACAGCTCCACATTACCATGCCCTTTAGCTCCCCATGGAGGCTGAGCTCGTGAGAAGGATTCTGTCCAGGG
ATGCCGCTCCCCTCCCCAGACCCGGAGTGCTCCTGAAAGAGTTTACCGTCAGCGGAAACATTCTGACAATCAGACTGACAGCCGCTGACCATAGGCAA
CTGCAACTGTCCAAGATGATCCTCAAGATGGTGCAACTGGATAGCATTGAGGATCTGGAAGTGACATGCACATGGAAACTGCCTACCCTCGCCAAATT
CTCCTTCCTCATCATTGTGCTCGTGATGATCGCTATGGAAGGCGGACACGCTCCCGAAGAGGAAATCTGGGAGGAACTGTCCGTGATGGAGGTCGAGG
TCACCTGTACCTGGAAGCTCCCCACACTGGCTAAGTTTAGCCCCTTACCTCGGCCAAATGATTAACCTCAGGAGACTGCTCCTGTCCGAGGGACTGGAA
GCCAGAGGCGAAGCCCTCGGCCTCGTGGGAGCCCAAGCCCCTGCCACAGAGGAACAGGAAGCCGCTAGCTCCAGCTCCATCTCCTACCCCTCCCCTCCA
CGAATGGGTCCTGAGAGAGGGAGAGGAAGCCGCTCACATTCACGCTAGCTCCTACATTAGCCCTGAGAAAGAGGAACAGTATATCGCTCAGTTTACCT
CCCAGTTTCTGTCCCTGCAATGCCTCGGCAATGCCGGAGGCCCTGGCGAAGCCGGAGCCACAGGCGGAAGGGGACCCAGAGGCGCTGGCGCTGCCAGA
GCCTCCGCCCTGGCGGAGGCCCTAGGGGAGCCGGAGCCGCTAGGGCTAGCGGACCCGGAGGCGGAGCCCCTAGGGGACCCCATGGCGGAGCCGCTAG
CGGACTGAATCAGGGAGCCTCCGCCTTTCCCACAACCATTAACTTTACCAGACAGAGACAGCCTAGCGAAGGCTCCAGCTCCAGGGAAGAGGAAGGCC
CTCTGGCTAGGAGAAGCCTCGCCCAAGACGCTCCCCCTCTGCCTGTGCCTGGCGTCCTGCTCAAGGAATTCACAGTGTCCGGCAATATCCTCGCCGCT
TTCGATGGCAGACACTCCCAGACACTGAAAGCCATGGTGCAAGCCTGGCCCTTTACCTGTCTGCCTCTGGGAGTGCTCATGAAAATCAAAGTGTCCGC
CAGAGTGAGATTCTTTTTCCCTAGCCTCAGGGAAGCCGCTCTGAGAGAGGAAGAGGAAGGCGTCGCCGCTGGCATTACCGATGACCAACTGCTCGCCC
TCCTGCCTCAGCCATTGCTCCCAGCTCACCACACTGTCCTTCTATGGCATTGTGTATGGCATTGTGAAAACCCCTGAGGAGAGATGAGGTCCCACTAT
GTGGCTCAGACAGGCATTCGTGGCTGCTCATGAATAACTGTTTCCTCAACCTCATCTCCAGCTGTCTGCAACAGCTCAGCCTCCTGATGTGGATTAC
CCAATGCTTTCTGCCTGTGTTTCTGGCTCAGGCTCCCTCCGGCCAATACCTCATCGAAAAGGTCAAGAGAAAGAAAAACGTCCTGAGACTGTGTTGCA
AAAAGCTCAAGATTTTCGCTATGCCTATGCAAGACATTGCCAGAGAGCCTGTGACAAAGGCTGAGATGCTGGAAAGCGTCATCAAAAACTATAAGCAT
TGCTTTCCCGAAATCTTTGGCAAAGCCTCCCTGGTCAGGAGAATCCTCAGCAGACGCTGCCCCTCTGCCTAGGCCTGCGCTGTGCTCAAGGATTT
CACAGTGTCCGGCAATCTGCTCCACTGTAGCCAACTGACAACCCTCAGCTTTTACGGAAACTCCATCTCCATCTCCGCCTCCAGTCCCTGCTCCAGC
ATCTGATTGGCCTCATGGTCTGGCTCAGCGCTAACCCTTGCCCTCACTGTGGCGATAGGACATTCTATGACCCTGAGCCTATCCTCTGCCCCTTGCTTT
ATGCCTGCCGCTAGCTGGAGCCCAAAAGAAGAAGCTTTGTGTATGTGTGGAAGACATGGGGAGAGGGACTGCCTAGCCAACCCATTATCCATACCTGTCT
GCTCCAGGCTAGGCTCATGAAAGAGGAAAAGCCCTGTGGTCAGCTGGAGGCTCGAGCCTGAGGATGGCACAGCCCTCTGCTTTATCTTTGTGTATTTCT
TTCTGCCTGACCATCTGTCCTTCGGAAGGCCTTTCCATCTGAATTTCTGTGACTTTCTGGCTGCCCCCTATCTGGGACAGATGATCAATCTGAGAAGG
CTCCTGCTCAGCCATATCCATGCCTCCAGCTATATCTCCCCCGAAAAGGAAGAGCAACAGGCTCCCGCTACCGAAGAGCAAGAGGCTGCCTCCAGCTC
CAGCACACTCGAGGTCACCCTCGGCGAAGTGCCTGCCGCTGAGTCCCAGGCTTGGCCTTTCACATGCCTCCCCCTCGGCGTCCTGATGAAGGGAC
AGCATCTGCATCTGGAAACCTTTAAGGCTGTGCTCGACGGACTGTCCACCGAAGCCGAACAGCCTTTCATTCCCGTCGAGGTCCTGGTCGACCTCTTC
CTCAAGGAAGGCGCTTGCGATGAGCTCTTCTCGCCGAAGTGCCTGGCGCTCAGGGACAGCAAGGCCCTAGGGGAAGGGAAGAGGCTCCCAGAGGCGT
CAGGATGGCCGCTAGGCTCCAGGGAGGCGCTCCCAGAGGCCCTCACGGAGGCGCTGCCTCCGCCCAAGACGGAAGGTGTCCCTGTGGCGCTAGGAGAC
CCGATAGCAGACTGCTCGGCCCTAGGGGAGCCGGAGCCGCTAGGGCTAGCGGACCCAGAGGCGGAGCCCCTAGGGGACCCCATGGCGGAGCCGCTAGC
GCTCAGGATCTGGCTGGCCAAAGCCTCCTGAAAGACGAAGCCCTCGCCATTGCCGCTCTGGAACTGCTCCCCAGAGAGCTCTTCCCTCCCCTCTTCAT
GGAGCCTGCCACACAGAGACAGGATCCCGCTGCCGCTCAGGAAGGCGAAGACGAAGGCGCTAGCGCTGGCCAAGGCCCTAAGCCTGAGGCTCCCGAAG
CCGCTCAGCCTATGACAAGAAAAGGAAAGTGGATGGCCTCAGCACAGAGGCTGACAACCCTTTATCCCTGTGGAAGTGCTCGGCAGATGCCCTTGC
GGAGCCAGAAGGCCTGACTCCAGGCTCCTGCAACTGCATATCACAATGCCTTTCTCCAGCCCTATGGAAGCCGAACCCGGAGCCGTCCTGAAAGACTT
TACCGTCAGCGGAAACCTCCTGTTTATCAGACTGACAGCCGCTGACCATAGGCAACTGCAACTGTCCGAGGATATCCATGGCACACTGCATCTGGAAA
GGCTCGCCTATCTGCATGCCAGACTGAGAGAGCTCCTGTGTGAGCTCGGCAGACCCTCCGACTCCCAGGAACAGGGACACCCTCAGACAGGCTGTGAG
TGTGAGGATGGCCCTCGACGGACAGGAAAATGGATCCCCCTAACCCTGAGGAATTCGTCATCGGACTGAGAGTGTGGCAGTGGGAGGTCATCTCCTGCAA
ACTGATTAAGAGAGCCAACCAGACAGCCTGCCGCTCGACGTCGACGGACCCGGAGGCCCTGGCATTCCCGATGGCCCTGGCGGAAACGCTGGCGGAC
CCGGAGAGGCTGGCGCTACCGGAGGCAGACCCACCAGCCATAGCTATGTGCTCGTGACATGCCTCGGCCTCAGCTATGACGGACTGCTCGGCGATAAC
CAAATCATGCCCAAAACCGGATTCCTCCTGCTCAAGTATAGGGCTAGGGAACCCGTCACCAAAGCCGAAATGCTCGGCTCCGTGGTCGGCAATTGGCA
ATACTTTTTCCCCTACCGGAATCCTCTGGCTCCTGATGAACAATTGCTTTCTGAATCTGTCCCCCAGAAAGCCTGCCGCTGAGTTTCAGGCTGCCCTCA
GCAGAAAGGTCGCCGAACTGGTCCTCACTTTCTGCTCCTGAAATACGAGCCAGAGAGCCTGTGACAAAGGCTGTGCCTGACTCCGACCCTGCCAGATAC
GAATTCCTCTGGGGACCCAGAGCCCTCGCCGAAACCTCCTACGTCAAGGTCCTGGAATACGTCGGCGTGTTCAGATGCGGAGCCAGAGGCCCTGAGTC
CAGGCTCCTGGAATTCTATCTGGCTATGCCTTTCGCTACCCCTATGGAAGCCGAAGCCACATGCCTCGGCCTCAGCTATGACGGACTGCTCGGCGATA
ACCAAATCATGCCCAAAGCCGGACTGCTCATCATTGTGCTCGCCATTGGCAATGCCGGAGGCCCTGGCGAAGCCGGAGCCACAGGCGGAAGGGGACCC
AGAGGCGCTGGCGCTGCCAGAGCCTCCGCCCCTAGGGGA
```

Cassettes for construction of a full-length HIV Savine

Cassette A1
ggatccaccATGACAGGCCCTTGCACAAACGTCAGCACCGTGCAATGCACACACGGAATCAGACCCGTCGTGTCCA
CCCAACTGCTCCTGAATGGCTCCCTGAGAAGCCTCTACAATACCGTCGCCACACTGTGGTGCGTCCACCAAAGGAT
TGACGTCAGGGACACAAAGGAAGCCCTCGACAAAATCGAACTCGGCGATGGCGGAGGCGCTGAAAGGCAAGGCACC
TCCAGCTCCTTCAACTTTCCACAAATCACACTGTGGCAAAGGCCTCTGGTCACCGAACCCTTCAGAAAAAGAATC
CCGATATGGTGATTTACCAGTACATGGACGATCTGTATGTGGGAAGCGATCTGGAAATCGGACAGCATTTTACCAC
ACCCGATAAGAAACACCAAAAGGAACCACCATTCCTCTGGATGGGATACGAACTGCATCCCGATAGGTGGACCGTC
CAGCCTCTTAATTTCCCTCAGATTACCCTCTGGCAGCGTCCCCTCGTGACAATCAAAATCGGCGGACAGCTCATAG
AGGCTCTGCTCGACACAGGCTCCTATGGCAGAAAGAAACGTAGGCAACGTAGACGCGCTCCTCAGAGCAGCAAGGA
TCACCAATACCCTATCTCTGAGCAACCCCTCTCCTTCTTTAGGGAAAACCTGGCTTTCCAGCAAGGTAAAGCCAGA
GAGTTTTCCAGCGAACAGACAAGAGCCAATAGCTCCGCCTCCAGGAAGAGCCCCCAAATCTCCGGCGAAAGCTCCG
TCATTCTGGGATCTGGCACCAAAAACGCCGCTACTAGAAGAATCGAAGTGAAAGATACCAAAGAGGCTTTGGATAA
GATTGAGGAGGTGCAAAAGAAAAGCGAGCAAAAGACACAACAGGCTGCCGCTAAAGCCGGATACGTCACCGATAGG
GGAAGGCAAAAGATTATCTCCCTGACAGAGACAACCAATCAGAAAACCGAACTGCATGCCATTCAAGAAGCCACTA
CCACACTGTTTTGCGCCAGCGATGCCAAAGCCTATGAGACAGAGGTCCACAATGTGTGGGCCACACACGCTTGCGT
CCCCGCTGACGATACAGTGCTGGAGGAGATGAACCTCCCCGGAAAATGGAAGCCTAAGATGATTGGCGGAATCGGC
GGATTCATTAAGGTGAGAAAAATCGGACCCGAAAACCCTTACAATACCCCAATCTTCGCTATCAAGAAAAGGACT
CCACCAAATGGAGAAAGCTCGTGGATTTCAGAGTTAGGATTATCAATATCCTCTACCAAAGCAATCCCTATCCTAG
CTCCGAAGGCTCCAGGCAAACCAGAAAGAATAGGAGAAGGAGATGGGGAGGCGAACGGGGTAGGGATAGGTCCGTG
AGACTGGTCAACGGATTCTTAGCCCTCGCCTGGGACGATCTGAGAAACCTCTGCCTCTTCGAAAACCTCTGGGTCA
CCGTCTACTATGGCGTCCCCGTCTCGAGACAGGCTGCCACAAACCCTCTTCTGTGCCTCCGACGCTAAGGCTTACGC
TGCCATGGCTGGCAGAAGCGGCGGCACAGACGAAGAGCTCCTGAGGGCTATCAGAATCATTAACATTCTGTATCAG
TCCAACCCTTACCCTTCCGCTAGTATGAGAATCAGAACCTGGAACAGCCTGGTCAAGCATCACATGCACATCTCCA
AGAAAGCCAAAGGCTGGTTCTATAGGCATCACTTTGAGGAGTCCGAGCTCGTGAATCAGATTATCGAAAAGCTCAT
CAAAAAGGAAAAGGTCTACCTATCATGGGTACCAGCCCACAAGGGAATCGGACAAACCAAAGAGCTCCAGAAACAG
ATTATCAAAATCCAAAACTTTAGGGTCTACTATAGGGATAGCAGAGACCCTATCTGGAAGGGACCCAAAAGCTTTG
AGGAAATCTGGAACAATATGACATGGATTGAGTGGGAGAGAGAGATTAGCAATTACACAAGCCAAATCTATAAGAT
TCTGAAACCCGAACCCACAGCCCCTCCCGCTGAGAATTTCAGATTCGGTGAGGAAACTACACCCTCCCAAAAGCAA
GAGCAAAAGGATAAGGAGCAATACGATCAGATTCTTATTGAGATTTGCGGCAAGAAAGCTATTGGTACGGTGCTCG
TGGGACCTACCCCTGTGAATATCATTGGCAGAATTTACGAAACCTATGGCGATACCTGGGAGGGCGTCGAGGCTCT
GATCAGAATCCTCCAGCAACTGATGTTTATCCATTTCAGAATCGGATGTTTTCATTGCCAAGTGTGTTTTCTCACC
AAAGGTCTCGGCATTAGCCACGGAAGGAAAAAGAGAAAACAGAGAAGGGGAGCTCCCCAAGCTGCCATGGACCCCG
TGGACCCCAAGCTGGAGCCTTGGAAACACCCTGGCTCCCAGCCTAAGACAGCCTGTTACAAATGCTATTGCAAAAA
GTGCCCTAGCGAAGAGACAACCCCTAGCCAGAAACAGGAACAGAAAGACAAAGAACTCTACCCCCCTTTAGCCAGC
CTCAAGTCCCTGTTTGGCAATGACAATTTCAATATGTGGAAGAATGACATGGTGGAACAGATGCAAGAAGACATTA
TCTTACTATGGGACCAAAGCCTCAAGCCTTGCGTCAAGCTCGACGTCGGCGATGCCTATTTCTCCGTGCCTCTGGA
TAAAAACTTCAGAAAGTATACCGCTTTCACAATCCCTAGCACAAACAATGAGCAACTGAAAGGCGAAGCCATCCAT
GGCCAAGTGAATTGCTCACCAGGCATTTGGCAACTGGATTGCACACACCTGGAGGGAAAGATTATCCCTAAGGTCA
AGCAATGGCCTCTGACAGAGGAAAAGATTAAGGCTCTGACTGAGATTTGCAAAGAGATGGAGGAAGAGGGAAAGAT
TAGCATGGATGACCTCTACGTCGGCTCCGACCTGG

FIGURE 30

```
AGATTGGCCAACATAGGACCAAAATCGAAGAGCTCAGGGAACACCTCCTGAAATGGGGACTCACCGAAACCACAAA
CCAAAAGACTGAGCTCCAAGCTATCCATCTGGCTCTGCAAGACTCCGGCTTAGAGGTCAACATTGTGACAGACATT
CCCGCTGAGACTGGTCAAGAGACCGCCTTTTTCATTCTGAAACTGGCTGGCAGATGGCCTGTGAAAGTCATTCACA
CAGACAATGGCAGGACAAAGATTGAGGAACTGAGACCGCATCTGCTCAAATGGGGCTTCACAACCCCTGACAAAAA
GCATCAGAAAGAGCCTCCCTTTCTGTCTAGTGTCAAGAAACTGACAGAGGATAAGTGGAACGAACCCCAGAAAATC
AAGAGACGCAGAGAAAATCACACAATGAATGGCCATACTGCCACAGAGTCCAGAATCAGCAAGACAGAAACGAAA
AGGAACTGCTGGAGCTCGACAAATGGGCAAGCCTCTGGAATTGGTTTAACATTACCGACACCGGAAATAGCTCCAA
AGTGTCCCAGAATTACCCTATCGTCCAGAATGTCCAAGGCCAAATGGTCCACCAACCCCTCTCCCCAGACTCATC
GGACTGAGAATCGTTTTCGCTGTGCTCAGCATTATCAATAGGGTCAGGCAAGGCTATAGCCCTCTGTCCTTCCAAA
CCCTCCCCCTCATCCATCTGCAATACTTTGACTGTTTCGCTGACTCCACCATTAGGAGAGCCATCTTGGGACACAT
AGTGAGAAGGAGATGCGAATACGCTGTGGGACTCGGAGCCATGTTCCTTGGCTTTCTGGGTGCCGCTGGCTCCACC
ATGGGCGCTGCCTCCATGACACTGACAGTGCAAGCCTATGACCCTAGCAAAGACCTCATTGCTGAGATTCAGAAAC
AGGGCCAGGGTCAGTGGACATTTCAGATTTTCCAAGAGCCTTTCAAAAACGGAACCGTCCTGGTCGGCCCTACACC
CGTCAACATCATCGGAAGGAACATGCTGACACAGCTTGGCCGCACTCTCAACTTTCCCATTAGCAAAGGCAGCCCT
GCTATCTTTCAGTCCAGCATGCCACAGATTCTGGAGCCTTTTAGGATAAAAAACCCTGAGATGGTCATCTATCAGT
ATCCTAGCCCTCTGACATTCGGATGGTGTTTCAAACTGGTCCCCGTGGACCCCAGCGAAGTGGAAGAGATCAACAA
GGGCGAAAACAATTGCCCCCTGTTTAGGAAATACACAGCCTTTACCATTCCCTCCATCAATAACGAAACCCCTGGC
ATTAGGTATCAGTATAACGTCCTGCCTCAGGGATGGGGAAGCACAATGGGAGCCGCCAGCATGACCCTCACCGTCC
AGGCTAGGCTACTGCTCAGCGGAATCGTCCAGCAACAGAGCAATCTGCTGGAGGAGAATAGGGAAATCCTCAGAGA
GCCTGTGCATGGCGTCTACTACGATCCCTCCAAGGATCTGGTCGCTGAAATCCAAAAGCAAGGCAGAGAGGAACTG
TCCACCATGGTGGATATGGGAAACTACGACCTCGGAGTGGACAATAACCTCGCCGCTATTAGAATCCTGCAACAGC
TCATGTTCATTCACTTTAGGATTGGCTGCCAGCACTCCAGGATTGGCATCATCCGTCAGAGAAGGGCCAGAGCTCC
CAGGAAAAAGGGATGCTGGAAGTGTGGCAGAGAGGGACACCAGATGAAGGATTGCACTGAGAGACAGCTAACTTT
CTGGGAAAGGATGCCAGACTGGTTATCAAAACCTATTGGGGACTGCATACCGGTGAGAGAGACTGGCACCTCGGCC
ATGGCGTCAGCATTGAGTGGAGGATAAGGGAAAGGGCTGAGGATAGCGGCAACGAAAGCGAAGGCGACACAGAAGA
GCTCAGCACATTGGTGGACATGGGCAATTACGATCTGTCTAGCCCTGCCCCCAGGGACCCGATAGGCTGGAGAGA
ATCGAAGAGGAAGGCGGAGAGCAAGGCAGAGGCAGAAGCGTCAGGCTCGTGAATGGCAGAGAGGTCGAGGAAGTCA
ATGAGGAGAGAATAACTGTCTGCTTCACCCTATCAGTCAACATGGCATGGAAGACGAAGAGAGAGAGGTCAATAG
CGATATCAAAGTGGTCCCCAGAAGGAAAGCCAAAATCATTAGGGATTACGGAAAGCAAATGGCTGGCGATGACTGT
GTGGCCAGCTTCTCTTCCGAGCAAACAGGGGCTAACTCCTCTACAAGCAGAAAGCTGGGAGACGGAGGCGGAGCCG
ACAGACAGGGAACAAGCTCCAGCTGTTTCAATTGCGGCAAAGAGGGACACATTGCCAAAAACTGTAGGGCCCCTCG
CAAGAAAGGTTGTTGGAAATGCGGAAAGGAAGGCCATCAAATGAAAGACTGTACCGAAAGGCAAGCCAATTTCCTC
GGCAAAATCTGGCCCTCCAACAAAGGCAGACCCGGAAACTTTCTCCAAAGCAAATGGCTCTGGTATATCAAAATCT
TTATCATGATCGTCGGTGGACTGATTGGCCTCAGGATTATCTTTGCCGTCCTGTCCATCGTTAACGGAGCCGTGAG
CCGAGACCTCGATAAACATGGCGCTATTACAAGCTCCAATACCGCTGCCAATAACGCTGACTGTGTCTGGCTGAAG
GCTGCTGCCATGACACCCCTGGAGATCATCGCTATCGTCGCCTTTATCGTCGCCCTCATCATAGCCATTGTGGTCT
GGACAATCGTCTACATTGAGTATGTCGACtgaagatctgaattc
```

Figure 30 (Cont)

A2 fragment
ggatccaccATGACAGGCCCTTGCACAAACGTCAGCTCCGTGCAATGCACACACGGAATCAAACCCGTCGTGTCCA
CCCAACTGCTCCTGAATGGCTCCCTGAAAAGCCTCTACAATACCGTCGCCACACTGTGGTGTGTCCACCAAAGGAT
TGAGGTCAAGGACACAAAGGAAGCCCTCGACAAAATCGAACTCGGCGATGGCGGAGGCGCTGAAAGGCAAGGCACC
TCCAGCTCCATCAACTTTCCACAAATCACACTGTGGCAAAGGCCTCTGGTCACCGAACCCTTCAGAAAAGAGAATC
CCGAAATGGTGATTTACCAGTACATGGACGATCTGTATGTGGGAAGCGATCTGGAAATCGGACAGCATTTTACCAC
ACCCGATAAGAAACACCAAAAGGAACCACCATTCCTCTGGATGGGATACGAACTGCATCCCGATAGGTGGACCGTC
CAGCCTTTTAATTTCCCTCAGATTACCCTCTGGCAGCGTCCCCTCGTGACAATCAAAATCGGCGGACAGCTCATAG
AGGCTCTGCTCGACACAGGCTCCTATGGCAGAAAGAAACGTAGGCAACGTAGACGCGCTCCTCAGAGCAGAAAGGA
TCACCAATACCCTATCTCTGAGCAACCCCTCTCCTTCTTTAGGGAAAACCTGGCTTTCCAGCAAGGTAAAGCCAGA
GAGTTTTCCAGCGAACAGACAGGAGCCAATAGCTCCGCCTCCAGGAAGAGCCCCCAAATCTCCGGCGAAAGCTCCG
TCATTCTGGGATCTGGCACCAAAAACGCCGCTACTAGAAGAATCGATGTGAGAGATACCAAAGAGGCTCTGGATAA
GATTGAGGAGGAGCAAAACAAAAGCAAGCAAAAGACACAACAGGCTGCCGCTAAAGCCGGATACGTCACCGATAGG
GGAAGGCAAAAGATTATCTCCCTGACAGAGACAACCAATCAGAAAACCGAACTGCATGCCATTCAAGAAGCCGATA
CCACACTGTTTTGCGCCAGCGATGCCAAAGCCTATGACACAGAGGTCCACAATGTGTGGGCCACACACGCTTGCGT
CCCCGCTGACGATACAGTGCTGGAGGAGATGAACCTCCCCGGAAAATGGAAGCCTAAGATGATTGGCGGAATCGGC
GGATTCATTAAGGTGAGAAAGATCGGACCCGAAAACCCTTACAATACCCCAATCTTCGCTATCAAGAAAAAGAACT
CCACCAAATGGAGAAAGCTCGTGGATTTCAGAATTAGGATTATCAAAATCCTCTACCAAAGCAATCCCTATCCTAG
CTCCGAAGGCACCAGGCAAACCAGAAAGAATAGGAGAAGGGGATGGGGAGGCGAACAGGGTAGGGATAGGTCCGTG
AGACTGGTCAACGGATTCTTAGCCCTCGCCTGGGACGATCTGAGGAAGCCTCTGCCTCTTCGACAACCTCTGGGTCA
CCGTCTACTATGGCGTCCCCGTCTGGAGAGAGGCTAACACAACCCTCTTCTGTGCCTCCGACGCTAAGGCTTACGC
TGCCATGGCTGGCAGCAGCGGCAGCACAGACGAAGAGCTCCTGAAGGCTGTCAGAATCATTAAGATTCTGTATCAG
TCCAACCCTTACCCTTCCGCTAGTATGAAAATCAGAACCTGGAAGAGCCTGGTCAAGCATCACATCTACATCTCCA
AGAAAGCCAATGGCTGGTTCTATAGGCATCACTTTGAGGAGTCCGAGGTCGTGAATCAGATTATCGAAAAGCTTAT
CAAAAAGGAAAAGGTCTACCTATCATGGGTACCAGCCCACAAGGGAATCGGACGAACCAAAGAGCTCCAGAAACAG
ATTATCAAAATCCAAAACTTTAGGGTCTACTATAGGGATAGCAGAGACCCTATCTGGAAGGGACCCAAAAGCCTTG
AGGAAATCTGGAACAATATGACATGGATTCAGTGGGAGAGAGAGATTAGCAATTACACAAACCTAATCTATAAGAT
TCTGAGACCCGAACCCACAGCCCCTCCCGCTGAGAATTTCGGATTCGGTGAGGAAACTACACCCTCCCAAAAGCAA
GAGCCAAAGGATAAGGAGCAATACGATCAGATTATTATTGAGATTTGCGGCAAGAAAGCTATTGGTACAGTGCTCG
TGGGACCTACCCCTGTGAATATCATTGGCAGAATTTACGAAACCTATGGCGATACCTGGGAGGGCGTCGAGGCTCT
GATCAGAATCCTCCAGCAACTGATGTTTATCCATTTCAGAATCGGATGTTTTCATTGCCAAGTGTGTTTTCTCACC
AAAGGTCTCGGCATTAGCCACGGAAGGAAAAAGAGAAAACAGAGAAGGCGAGCTCCCCAAGCTGCCATGGACCCCG
TGGACCCCAACCTGGAGCCTTGGAAACACCCTGGCTCCAGCCTAAGACAGCCTGTAACAAATGCTATTGCAAAAA
GTGCCCTAGCGAAGAGACAACCCCTAGCCAGAAACAGGAACAGAAAGACAAAGAACTCTACCCCCCTTTAGCCAGC
CTCAAGTCCCTGTTTGGCAATGACAATTTCAATATGTGGAAGAATAACATGGTGGAACAGATGCAAGAAGACATTA
TCTCACTATGGGACCAAAGCCTCAAGCCTTGCGTCAAGCTCGACGTCGGCGATGCCTATTTCTCCGTGCCTCTGGA
TAAAAACTTCAGAAAGTATACCGCTTTCACAATCCCTAGCACAAACAATGAGCAACTGAAAGGCGAAGCCATGCAT
GGCCAAGTGAATTGCTCACCAGGCATTTGGCAACTGGATTGCACACACCTGGAGGGAAAGATTATCCCTAAGGTCA
AGCAATGGCCTCAGACAGAGGAAAAGATTAAGGCTCTGACTGAGATTTGCACAGAGATGGAGCAAGAGGGAAAGAT
TAGCATGGATGACCTCTACGTCGGCTCCGACCTGGAGATTGGCCAACATAGGACCAAAATCGAAGAGCTCAGGGCA

Figure 30 (Cont)

```
CACCTCCTGAGATGGGGACTCACCGACACCACAAACCAAAAGACTGAGCTCCACGCTATCCATCTGGCTCTGCAAG
ACTCCGGCTTAGAGGTCAACATTGTGACAGACATTCCCGCTGAGACTGGTCAAGAGACCACCTATTTCATTCTGAA
ACTGGCTGGCAGATGGCCTGTGAGAATCATTCACACAGACAATGGCAGGACAAAGATTGAGGAACTGAGACCGCAT
CTGCTCAAATGGGGCTTCACAACCCCTGACAAAAAGCGTCAGAAAGAGCCTCCCTTTCTGTCTAGTGTCAAGAAAC
TGACAGAGGATAAGTGGAACAAACCCCAGAAAATCAAGGGACACAGAGAAAATCACACAATGAATGGCCATGCTGC
CACAGAGTCCCAGAATCAGCAAGACAGAAACGAAAAGGAACTGCTGGAGCTCGACAAATGGGCAAGCCTCTGGAAT
TGGTTTAACATTACCGACACCGGAAGTAGCTCCCAAGTGTCCCAGAATTACCCTATCGTCCAGAATCTCCAAGGCC
AAATGGTCCACCAACCCATCTCCCCCAGACTCGTCGGACTGAGAATCATTTTCGCTGTGCTCAGCATTATCAATAG
GGTCAGGCAAGGCTATAGCCCTCTGTCCTTCCAAACCCTCACCCTCATCCATCTGTATTACTTTGACTGTTTCGCT
GACTCCACCATTAGGAGAGCCATCCTTGGACACAGAGTGAGCAGGAGATGCGAATACGCTGTGGGAATCGGAGCCA
TGTTCCTTGGCTTTCTGGGTGCCGCTGGCTCCACCATGGGCGCTGCCTCCATCACACTGACAGTGCAAGCCTATGA
CCCTAGCAAAGACCTCATTGCTGAGATTCAGAAACAGGGTCAGGATCAGTGGACATATCAGATTTTCCAAGAGCCT
TTCAAAAACGGAACCGTCCTGGTCGGCCCTACACCCGTCAACATCATCGGAAGGAACCTGCTGACACAGATAGGCT
GCACCCTCAACTTTCCCATTAGCAAAGGCAGCCCTGCTATCTTTCAGTCCAGCATGACACAGATTCTGGAGCCTTT
TAGGAAACAAAACCCTGACATGGTCATCTATCAGTATCCTAGCCCTCTGACATTCGGATGGTGTTTCAAACTGGTC
CCCGTGGACCCCAGCGAAGTGGAAGAGACCAACAAGGGCGAAAACAATTGCCTCCTGTTTAGGAAATACACAGCCT
TTACCATTCCCTCCACCAATAACGAAACCCCTGGCATTAGGTATCAGTATAACGTCCTGCCTCAGGGATGGGGAAG
CACAATGGGAGCCGCCAGCATGACCCTCACCGTCCAGGCTAGGCAACTGCTCAGCGGAATCGTCCAGCAACAGAAC
AATCTGCTGGAGGAGAATAGGGAAATCCTCAAAGAGCCTGTGCATGGCGTCTACTACGATCCCTCCAAGGATCTGA
TCGCTGAAATCCAAAAGCAAGGCACAGAGGAACTGTCCGCCTTGGTGGATATGGGAAACTACCACCTCGGAGTGGA
CAATAACCTCGCCGCTATTAGAATCCTGCAACAGCTCATGTTCATTCACTTTAGGATTGGCTGCCAGCACTCCAGG
ATTGGCATCATCCGTCAGAGAAGGGCCAGAGCTCCCAGGAAAAAGGGATGCTGGAAGTGTGGCAAAGAGGGACACC
AGATGAAGGATTGCACTGAGAGACAGGCTAACTTTCTGGGAAAGGATGCCAGACTGGTTATCAAAACCTATTGGGG
ACTGCATACCGGTGAGAGAGACTGGCACCTCGGCCATGGCGTCAGCATTGAGTGGAGGACAAGGGAAAGGGCTGAG
GATAGCGGCAACGAAAGCGAAGGCGACAGAGAAGAGCTCAGCACAATGGTGGACATGGGCAATTACGATCTGTCTA
GCCCTGCCCCCAGGGGACCCGATAGGCTGGAGAGAATCGAAGAGGAAGGCGGAGAGCAAGACAGAGACAGAAGCGT
CAGGCTCGTGAATGGCAGTGAGGGCGAGGAAGTCAATAAGGGAGAGAATAACTGTCTGCTCCACCCTATGAGTCAA
CATGGCATGGAAGACGAAGACAGAGAGGTCAATAGCGATATCAAAGTGGTCCCCAGAAGGAAAGCCAAAATCATTA
GGGATTACGGAAAGCAAATGGCTGACGATGACTGTGTGGCCGGCTTCTCTTCCGAGCAAACAAGGGCTAACTCCCC
TGCAAGCAGAAAGCTGGAGACGGAGGCGGAGCCGACAGACAGGGAACAAGCTCCAGCTGTTTCAATTGCGGCAAA
GAGGGACACATTGCCAAAAGCTGTAGGGCCCCTCGCAAGAAAGGTTGTTGGAAATGCGGAAGGGAAGGCCATCAAA
TGAAAGACTGTACCGAAAGGCAAGCCAATTTCCTCGGCAAAATCTGGCCCTCCAAAAAGGCAGACCCGGAAACTT
TCTCCAAAGCAAATGGCTCTGGTATATCAAAATCTTTATCATGATCGTCGGTGGACTGATTGGCCTCAGGATTATC
TTTGCCGTCCTGTCCATCATTAACGGGGCCGTGAGCCGAGACCTCGATAAACATGGCGCTATTACAAGCTCCAATA
CCGCTGCCAATAACCCTGACTGTGTCTGGCTGGAGGCTGCTGCCATGACACCCCTGGAGATCATCGCTATCGTCGC
CCTTATCGTCGCCCTCATCATAGCCATTGTGGTCTGGACAATCGTCTACATTGAGTATGTCGACtgaagatctgaa
ttc
```

Figure 30 (Cont)

B1 fragment ggatccaccATGCTCGAGAATATGCTCACCCAAATCGGATGCACACTGAATTTCCCTATCTCCCCCATTGAGACAG
TGCCTGTGAAACTGAAACCCGGAATGGATGGCGCCGCCACCTTTAGGCCTGGCGGAGGCAATATCAAAGACAATTG
GAGAAGCGAACTGTATAAGTATAAGGTCGTGAAGATTAAGCCTCTGGGAATCACATGGATTCCCGAATGGGAGTTC
GTCAACACACCCCACTGGTCAAGCTATGGTATCAGCTGGAGAAAGACCCTATCGTTGGCGTTGAGCCTCAGGATC
TCAACACGATGCTGAATCTTGTAGGAGGCCATCAGGCCGCTATGCAAATGCTGAAAGAGACAATCAATGAGGAAGC
CTCTGTCCTGTTTCTGGATGGCATTGACAAAGCTCAAGAGGAACATGAAAAGTATCACTCCAACTGGAGGACAATG
GCCAACGACTTTAATCTGATGAAGCATCTCGTCTGGGCCTCTAGGGAGCTGGAGAGATTCGCTCTGAATCCCAGCC
TGCTGGAGACATCCGAAGGCTGTCAGCAAATTGCTGAGGAAGAGATTATCATTAGGTCCGAGAATTTCACAAACAA
TGTCAAAACCATTATCGTCCAACTCAACGAAAGCGTCGAGATTAACATGGGCGCTAGGGCTAGTGTCCTCAGAGGC
GGCAAGCTGGACGCCTGGGAAAAGATTAGGCTCAGGCCTGGCGGAAAGAAAAAGTATAGGCTCAAGGAGAAGGGAG
GCCTGGAGGGACTGGTTTACTCCAAAAAGAGGCAAGACATTCTGGATCTGTGGGTGTATAACACACAGGGATTCAC
TAGATGGGGAACCATGATCCTCGGCTTGGTGATTATCTGTAGCGCCAGCGAGAATCTGTGGGTGACAGTGTATTAC
GGAGTGCCTGTGTGGAGGAGACAGCTCCTGTCCGGCATTGTGCAACAACAAAATAACCTCCTGAGGGCTATCGAAG
CCCAACAGCATCTGCTCCAGCTCACCGTCTGGGTCAGGCATTTCCCCAGGCCTTGGCTCCACGGCCTGGGACAGTA
CATCTATGAGACATACGGAGACACATGGGCGGGAGTGGAAGCCCTCACAGCCCTCATCACACCCAAAAAGATTAGG
CCTCCCCTCCCATCCGTGAAAAAGCTCACCGAAGACAGATGGAATGAGCCTCAAAAGACATATAGCGCTGGCGAAA
GGATTATCGATATCATTGCATCCGACATTCAGACTAAGGAACTGCAAAAGCAAATCCTAAAGATTCAGAATTTCGC
TGTGTTTATCCATAACTTTAAGAGGAAGGGAGGCATTGGCGGCTACTCCGCCGGAGAGAGAATCATTGACATTATC
GCCACCGATATCATTCCCGTGGGCGAAATCTATAAGAGATGGATCATTCTGGGACTCAACAAATCGTGAGAATGT
ATCTACCCGTCAGCATTCTGGATATCAGAGTGAGACAGGGATACTCCCCCCTCAGCTTTCAGACACTGCTGCCCGC
TCCCAGAGGCCCTGACAGACTCGGAGGCATTGAGGAAGAGTCCAGCCAGGACCATCAGTATCCCATTCCCGAACAG
CCTCTGCCTCAGACAAGGGGAGACAATCCCACAGACCCTAAGGAAAGCAAAAAGGCTAGTGGAGGGTCGAGTCCA
TGAATAAGGAACTGAAAAAGATTATCGGACAGGTCAGGGACCAGGCTGAGCACCTGAAAACCGCTGTGCAAATGGC
TGCCATGCAGATGCTCAAGGATACCATTAACGAAGAGGCTGCCGAGTGGGACAGAGTCCATCCCGTCCATGCCGGG
CCCGTTCCCCCTCTCACCGAGATTTGTAAAGAAATGGAAAAAGAAGGCAAAATCTCCAAGATTGGCCCTGAGAATC
CCTATAACACACCCATCTTTGCCATTCAAGTGAGAGAGCAAGCCGAACACCTCAAGACAGCCGTCCAGATGGCAGT
CTTCATTCACAATTTCAAAAGGAGAGGCGGAATCGGAGGCAAAAAGAAAGATAGCACAAAGTGGAGGAAACTGGTA
GACTTTAGGGAGCTCAACAAACGTACACAGGATTTCTGGGAGGTCCAGCTCGGCTTTTTGGCTCTGGCTTGGGATG
ACCTCAGGAGCCTGTGTCTGTTCAGCTATCACAGACTGAGAGACTTTATCCTCATCGTTGCCAGAATCTGCCGACA
TAGCAGAATCGGCATCACTAGGCAACGTAGAGGTAGGAACGGCGCCTCCAGTTCCGCTGCCCCCAAAATCTCCTTC
GACCCCATTCCCATTCACTATTGCGCTCCCGCTGGCTTCGCTATCCTCAAGTGTAACGATAAGAACTTCAATGGCG
AAGAGGATTGGCATCTGGGACAGGGAGTGTCCATCGAATGGAGACAGAAAAGCTATAGCACACAGGTGGACCCTGA
CCTCGCCGATCAGCCTAGCCTCTATCCTCCCTTAGCTTCCCTGAAAAGCCTCTTCGGAAACGATCCCTTATCCCAA
GCCGCTAGAAGGGCTATCCTCGGCCATATAGTCAGGAGAAGGTGTGAGTATCAGTCCGGACACAATAAGGTCGGCT
CCCTGCAATACCTCGCACTCAGTCAACCCACAACCGCTTGCTACAAGTGTTACTGTAAGAAATGTTGCTTCCACTG
TCAGGTCTGCTTCCTGAAGAAGGGACTGGGAATCAGGGATTACGGAAAGCAAATGGCTGGCGATGACTGTGTGGCC
AGCAGGCAAGACGAAGACGCAGCCAAGTACCATAGCAATTGGAGAACCATTGGCAATGAGTTTAACCTCCCCCCTA
TCGTCCCTAAGGAAATCGTCGCAAATTGCAATAAGTGTAACGAATGGACACTGGAACTGCTGGAGGAACTGAAACA
TGAAGCCGTGAGACACTTTCCCAGACCCTGGCTGCATGGCCTCGGTCAACACGATATCATTAGCCTCTGGGATCAG

Figure 30 (Cont)

```
TCCCTGAAACCCTGTGTGAAACTGACACCCCTCTGCGTCACCCTCAACTGTACCAATGCCAATCTGATGAAGAGAT
ACTCCACCCAAGTGGACCCCGATCTGGCTGACCAACTGATTCACCTCCACTATTTCGATTGCTTTGCCGATAGCGC
AATCCATCCCATCGGCCAACACGGAATGGAGGATGAGGATAGGGAAGTGCTGAAATGGAAATTCGATAGCCATCTG
GCTCTCAGGCATATCGCTTCTAGTCCTATCGATACCGTCCCCGTCAAGCTCAAGCCTGGCATGGACGGACCCAAAG
TGAAACACTGGCCCCTCACCGAAGAGAAAATCAAAGCCATTTGGCCTAGCAACAAGGGAAGGCCTGGCAATTTCCC
GCAGTCCAGGCCTGAGCCTACCGCACCCCAGCCGAGAGCTTTAGATTCGGCATTAGCAAAAGGCTAAGGGATGG
TTTTACAGACACCATTACGATAGCCGACACCCTAAGGTCAGCTCCGAGGTCCACATTCCCCTCGGCATGATGACCG
CTTGCCAAGGCGTCGGCGGACCCAGTCACAAAGCCAGGGTACTGGCAGAGGCTATATCCAGGTGAACAACGCTAA
CATTCCTCCCATTGTGGCCAAAGAGATTGTGGCAAACTGTGACAAATGCCAGCTCAAGAGTGAGGCTATTCACGGA
CAGGTGAACTGTAGCCCTTCCGAGGGAACAAGACAGACTAGGAAGAACAGACGTAGAAGGTGGCGTGCGAGGCAAA
GGCAAATCCACTCCATCTCCGAGAGGATTCTGGGACAGATGAGGGAACCCAGAGGCTCCGACATTGCCGGTACTAC
AAGCACACTGCAAGAGCAAATCGCATGGATGACAAGCAATCCCCCTAGCATTCAACAAGAGTTTGGCATTCCCTAT
AACCCTCAGTCCCAGGGCGTCGTGGAAAGCATGAACAAAGAGCTAAAGAAAATCATTGGCAGACAGGAGATCCTCG
ATCTCTGGGTCTACCATACCCAAGGCTATTTCCCTGACTGGCAGAATTACACACCCGGACCCGGAGTCAGATACCC
TAGCAGAGAAAGACAGAGACAGATTCATTCTATTAACGAATGGATTCTCAGCAACTGCCTCGGCAGATCCGCTGAG
CCTGTGCCTCTGCAACTGTATAAGACACTGAGAGCCGAACAGGCTACCCAAGAGGTCAAGAATTGGATGACCGAGA
CACTGCTCGTGCAAAACGCTAACCCTGACTGTGAGAGAGTGTATCTGGCTTGGGTCCCCGCTCATAAAGGCATTGG
CGGAAACGAACAGGTGGACAAACTGGTCAGCGCTGGCATTAGGAAAACAGACCCTAACCCTCAGGAAATCCATCTG
GAAAACGTCACCGAGAACTTTAACATGTGGAAAAACGATATGGTGGAGCAAATGCATGAGGCTGGCTATGCCATTC
TGAAATGCAATAACAAAAGGTTCAACGGAACTGGACCCAGTAAGAATGTGTCCACCGTCCAGTGTACCCATGGCCT
AGAGCTCAAGAATAGCGCTATCTCCCTGCTCAACGCTACCGCTATCGCTGTGGCTGGGTGGACCGATAGGGTTATC
GAAGTGGTTCAGTCCCGGCATCCCAAAGTGTCCAGCGAAGTGCATATCCCTCTGGGAGACGCTAGGCTCATCATTA
GGACATACTGGGGCCTCCACACAGGCGCTGCTATGGGCGGTAAATGGTCCAAGTGCTCCCTCGTCGGATGGCCCGC
AGTGAGAGAGAGAATCAGACAGACACCCCCTGCCGCTGAGGGAGTGCTCAAGACCGGCAAGTACTCTAGGAAGAGG
GGTGCCCATACCAATGACGTCAAGCAACTGACAGAGGCTGTGCAAAAGATTGCCACAGAGTCTAGCTGGGAGGGTC
TGAAATACTGGGGGAATCTGCTCCAGTACTGGGGCCAGGAACTGAAAATCTCCGCCGTCAGCCTCCTGAATGCCAC
AGCCATTGAGCTGCCTGAGAAAGAAAGCTGGACCGTCAACGATATCCAAAAGCTCGTGGGAAAGCTCAACTGGGCA
TCCCAGATTTACCCCGGAAGAGCCATTGAGGCTCAGCAACACATGCTGCAACTGACAGTGTGGGCATTAAGCAAC
TGCAAGCCAGAGTGCTCGCCATTGAGAGATACCTCGCCCTCCAGGATAGCGGATTGGAAGTGAATATCGTCACCGA
TAGCCAATACGCTCTAGGCATCATTCAGGCTCAGCCTGACAAAAGCGAAAGGGAAATCTCCAACTATACCAATCAG
ATTTACAAGATCCTCACCGAATCTCAAAATCAACAGGATAGGAATGAGAAAGACCTCCTGGCTCCCACAAAGGCTA
AGAGAAGGGTCGTGCAAAGGGAAAAGCGTGCCGTCGGCATTGGCGCTATGTTTCTCGGATTCCTCGGCGCTGCCAA
ACCCAAAATGATCGGAGGCATTGGAGGCTTTATCAAAGTCAGGCAGTATGACCAAATCCTTATCGAAATCTGTGGA
AACAAGGCTATCTCCTACCATAGGCTCAGGGATTTCATTCTGATCGTCGCTAGGATTGTGGAACTGCTCGGCCGTA
GCTCCCTGAAAGGCCTCCAGAGAGGCACACTGAATGCCTGGGTGAAAGTGATTGAGGAAAAGGGATTCAGTCCCGA
AGTGATTCCCATGTTTTCCGCTCTGTCCGAGGGAGCCACACTCGAGtgaagatctgaattc
```

Figure 30 (Cont)

B2 fragment

```
ggatccaccATGCTCGAGAATATGCTCACCCAAATCGGATGCACACTGAATTTCCCTATCTCCCCCATTGACACAG
TGCCTGTGAAACTGAAACCCGGAATGGATGGCGCCGCCATCTTTAGGCCTGGCGGAGGCAATATGAAAGACAATTG
GAGAAGCGAACTGTATAAGTATAAGGTCGTGAAGATTAAGCCTCTGGGAATCACATGGATTCCCGAATGGGAGTTC
GTCAACACACCCCACTGGTCAAGCTATGGTATCAGCTGGAGAAAGAGCCTATCGTTGGCGCTGAGCCTCAGGATC
TCAACACGATGCCGAATACTGTAGGAGGCCATCAGGCTGCTATGCAAATGCTGAAAGACACAATCAATGAGGAAGC
CGCTGTCCTGTTTCTGGATGGCATTAACAAAGCTCAAGAGGAACATGAGAAGTATCACTCCAACTGGAGGACAATG
GCCAACGACTTTAATCTGATGAAGCATCTCGTCTGGGCCTCTAGGGAGCTGGAGAGATTCGCTCTGAATCCCGGCC
   GGAGACATCCGAAGGCTGTAAGCAAATTGCTGAGGAAGAGATTATCATTAGGTCCGAGAATTTCACAAACAA
TGTCAAAACCATTATCGTCCACCTCAACGAAAGCGTCGAGATTAACATGGGCGCTAGGGCAAGTGTCCTCAGCGGC
GGCAAGCTGGACGCCTGGGAAAAGATTAGGCTCAGGCCTGGCGGCAAGAAAAAGTATAGGCTCAAGGAGAAGGGAG
GCCTGGACGGACTGATTTACTCCCAAAAGAGGCAAGACATTCTGGATCTGTGGGTGTATAACACACAGGGATTCAC
TAGATGGGGAACCTTGATCCTCGGCTTGGTGATTATCTGTAGCGCCAGCGAGAATCTGTGGGTGACAGTGTATTAC
GGAGTGCCTGTGTGGAGGAGACAGCTCCTGTCCGGCATTGTGCAACAGCAAAATAACCTCCTGAGGGCTATCGAAG
CCCAACAGCATCTGCTCCAGCTCACCGTCTGGGTCAGGCATTTCCCCAGGCCTTGGCTCCACAGCCTGGGACAGTA
CATCTATGAGACATACGGAGACACATGGTCGGGAGTGGAAGCCCTCAAAGCCCTCATCAAACCCAAAAAGATTAAG
CCTCCCCTCCCATCCGTGAAAAAGCTCACCGAAGACAAATGGAATAAGCCTCAAAAGACATATAGCGCTGGCGAAA
GGATTGTCGATATCATTGCAACCGACATTCAGACTAAGGAACTGCAAAACCAAATCATAAAGATTCAGAATTTCGC
TGTGTTTATCCATAACTTTAAGAGGAAGGGAGGCATTGGCGGCTACTCCGCCGGAGAGAGAATCATTGACATTATC
GCCAGCGATATCGTTCCCGTGGGCGATATCTATAAGAGATGGATCATTCTGGGACTCAACAAAATCGTGAGAATGT
ATTCACCCGTCAGCATTCTGGATATCAGAGTGAGACAGGGATACTCCCCCCTCAGCTTTCAGACACTGATGCCCGC
TCCCAGAGGCCCTGACAGACTCGAACGCATTGAGGAAGAGTCCAGGCAGGACCATCAGTATCCCATTTCCGAACAG
CCTCTGTCTCAGACAAGGGGAGACAATCCCACAGACCCTAAGGAAAGCAAAAAGGCTAGTGGAGTGGTCGAGTCCA
TGAATAAGGAACTGAAAAAGATTATCGGACAGGTCAGGGACCAGGCTGAGCACCTGAAAACCGCTGTGCAAATGGC
TGCCATGCAGATGCTCAAGGATACCATTAACGAAGAGGCTGCCGAGTGGGACAGAATCCATCCCGTCCATGCCGGA
CCCATTGCCCCTCTCACCGAGATTTGTAAAGAAATGGAAAAAGAAGGCAAAATCTCCAGGATTGGCCCTGAGAATC
CCTATAACACACCCGTCTTTGCCATTCAAGTGAGAGACCAAGCCGAACACCTCAAGACAGCCGTCCAGATGGCAGT
CTTCATTCACAATTTCAAAAGGAAAGGCGGAATCGGAGGCAAAAAGAAAGATAGCACAAAGTGGAGGAAACTGGTT
GACTTTAGGGAGCTCAACAAACGTACACAGGATTTCTGGGAGGTCCAGCTCGGCTTTTCGGCTCTGGCTTGGGATG
ACCTCAGGAGCCTGTGTCTGTTCAGCTATCACAGACTGAGAGACTTTATCCTCATCGTTGCCAGAACCTGCCGACA
TAGCAGAATCGGCATCACTAGGCAACGTAGAGGTAGGAACGGCTCCTCCAGGTCCGCTGCCCCAAAATCTCCTTC
GACCCCATTCCCATTCACTATTGCGCTCCCGCTGGCTTCGCTATCCTCAAGTGTAACAATAAGACATTCAATGGCG
AAAAGGATTGGCATCTGGGACAGGGAGTGTCCATCGAATGGAGAAAGAAAAGCTATAGCACACAGGTGGACCCTGA
CCTCGCCGATCAGCCTAGCCTCTATCCTCCCTTAGCTTCCCTGAAAAGCCTCTTCGGAAACGATCCCTCATCCCAA
GCCGCTAGAAGGGCTATCCTCGGCCAAATAGTCAGGAGAAGGTGTGAGTATCAGTCCGGACACAATAAGGTCGGCT
CCCTGCAATACCTTGCACTCAGCCAACCCAAAACCGCTTGCTACAAGTGTTACTGTAAGAAATGTTGCTACCACTG
TCAGGTCTGCTTCCTGAAGAAGGGACTGGGAATCAGGGATTACGGAAAGCAAATCGCTGGCGCTGACTGTGTGGCC
AGCAGGCAAGACGAAGACGCAGCCAAGTACCATAGCAATTGGAGAACCATGGCCAGTGAGTTTAACCTCCCCCCTA
TCGTCGCTAAGGAAATCGTCGCAAGTTGTGATAAGTGTAACGAATGGACACTGGAACTGCTGGAGGAACTGAAACA
TGAAGCCGTGAGACACTTTCCCAGACCCTGGCTGCATGGCCTCGGTCAACACGATATCATTAGCCTCTGGGATCAG
```

Figure 30 (Cont)

```
TCCCTGAAACCCTGTGTGAAACTGACACCCCTCTGCGTCACCCTCAACTGTACCAATGCCAATCTGCTGAAGAGCT
ACTCCACCCAAGTGGACCCCGATCTGGCTGACCATCTGATTCACCTCCACTATTTCGATTGCTTTTCCGATAGCGC
AATCCATCCCATGGGCCTACACGGAATGGAGGATGAGGAAAGGGAAGTGCTGAAATGGAAATTCGATAGCCATCTG
GCTCTCAGGCATATCGCTTCTAGTCCTATCGATACCGTCCCCGTCAAGCTCAAGCCTGGCATGGACGGACCCAAAG
TGAAACAGTGGCCCCTCACCGAAGAGAAAATCAAAGCCATTTGGCCTAGCAACAAGGGAGGGCCTGGCAATTTCCT
GCAGTCCAGGCCTGAGCCTACCGCACCCCCAGCCGAGAACTTTAGATTCGGCATTAGCAAAAGGCTAAGGGATGG
TTTTACAGACACCATTACGAAAGCCAACACCCTAAGGTCAGCTCCGAGGTCCACATTCCCTCAGCATGATGACCG
CTTGCCAAGGCGTCGGCGGACCCAGTCACAAAGCCAGGGTACTGGCAGAGGCTATGTCCCAGGTGAACAACGCTAA
CATTCCTCCCATTGTGCCCAAAGAGATTGTGGCAAACTGTGACAAATGCCAGCTCAAGGGTGAGGCTATGCACGGA
CAGGTGGACTGTAGCCCTTCCGAGGGATCAAGACAGGCTAGGAAGAACAGACGTAGAAGGTGGCGTGAGAGGCAAA
GGCAAATCCGCGCCATCTCCGAGTGGATTCTGGGACAGATAAGGGAACCCAGAGGCTCCGACATTGCCGGTACCAC
AAGCACACTGCAAGAGCAAATCGCATGGATGACAAACAATCCCCCTGGCATTAAGCAAGAGTTTGGCATTCCCTAT
AACCCTCAGTCCCAGGGCGTCGTGGAAAGCATGAACAAAGAGCTCAAGAAAATCATTGGCAGACAGGAGATCCTCG
ATCTCTGGGTCTACAATACCCAAGGCTTTTTCCCTGACTGGCAGAATTACACACCCGGACCCGGAATCAGATACCC
TAGCAGAGCAAGACAGAGACAGATTCATGCTATTAGCGAAAGGATTCTCAGCAACTTCCTCGGCAGACCCGCTGAG
CCTGTGCCTCTGCAACTGTATAAGACACTGAGAGCCGAACAGGCTACCCAAGAGGTCAAGAATTGGATGACCGACA
CACTGCTCGTGCAAAACGCAAACCCTGACTGTGAGAAAGTGTATCTGGCTTGGGTCCCCGCTCATAAAGGCATTGG
CGGAAACGAACAGGTGGACAAACTGGTCAGCGCTGGCATTAGGAAAACAGACCCTAACCCTCAGGAAATCGATCTG
GAAAACGTCACCGAGAACTTTAACATGTGGAAAAACAATATGGTGGAGCAAATGCAAGAGGCTGGCTATGCCATTC
TGAAATGCAATAACAAAAAGTTCAACGGAACTGGACCCTGTAAGAATGTGTCCACCGTCCAGTGTACCCATGGCCT
AGAGCTCAAGAATAGCGCTGTCTCCCTGCTCAACGCTACCGCTATCGCTGTGGCTGAGTGGACCGATAGGGTTATC
GAAGTGGTTCAGTCCCAGCATCCCAAAGTGTCCAGCGAAGTGCATATCCCTCTGGGAGACGCTAGGCTCGTCATTA
AGACATACTGGGGCCTCCACACAGGCGCTGCTATGGGCGGTAAATGGTCCAAGTGCTCCCTCGTCGGATGGCCCGC
AGTGAGAGAGAGAATCAGACAGACACCCCCTGCCGCTGAGGGAGTGCTCAAGACCGGCAAGTACTCCAGGATGAGG
AGTGCCCATACCAATGACGTCAAGCAACTGACAGAGGTTGTGCAAAAGATTGCCACAGAGTCTAGCTGGGAGGGTC
TGAAATACTTGTGGAATCTGCTCCTGTACTGGGGCCTGGAACTGAAAAACTCCGCCGTCAGCCTCCTGAATGCCAC
AGCCATTGTGCTGCCTGAGAAAGAAGGCTGGACCGTCAACGATATCCAAAAGCTCGTGGGAAAGCTCAACTGGGCA
TCCCAGATTTACGCCGGAAGAGCCATTGAGGCTCAGCAACACTTGCTGCAACTGACAGTGTGGGGCATTAAGCAAC
TGCAAGCCAGAGTGCTCGCCATTGAGAGATACCTCGCCCTCCAGGATAGCGGATCGGAAGTGAATATCGTCACCGA
TAGCCAATACGCTCTAGGCATCATTCAGGCTCAGCCTGACAAAAGCGAAAGGGAAATCTCCAACTATACCAATCAG
ATTTACAAGATCCTCACCGAATCTCAAAATCAACAGGATAGGAATGAGCAAGAACTCCTGGCTCCCACAAAGGCTA
AGAGAAGGGTCGTGCAAAGGGAAAAGCGTGCCGTCGGCATTGGCGCTATGTTTTTCGGATTCCTCGGCGCTGCCAA
ACCCAAAATGATCGGAGGCATTGGAGGCTTTATCAAAGTCAGGCAGTATGACCAAATCCTTATCGAAATCTGTGGA
CAGAAGGCTATCTCCTACCATAGGCTCAGGGATTTCATTCTGATCGTCGCTAGGATTGTGGAACTGCTCGGCCATA
GCTCCCTGAGAGGCCTCCGGAGAGGCACACTGAATGCCTGGGTGAAAGTGGTTGAGGAAAAGGGATTCAATCCCGA
AGTGATTCCCATGTTTACCGCTCTGTCCGAGGGAGCCACACTCGAGtgaagatctgaattc
```

Figure 30 (Cont)

C1 fragment

```
ggatccaccATGCTCGAGAGCAACACACCCGCTAATAATGCCGATTGCGCGTGGCTGAAAGCCCAGGAAGAGGAAG
AAGTGGGATTTCCTGTGAGACCCCAAGTGCCTAGAGCTTGGAGGGCTATCCTCAACATTCCCAGGAGGATTAGGCA
AGGCTTTGAGAGAGCCCTCCTAGCCGCCGAATGGGACAGGGTTCACCCTGTGCACGCTGGCCCTGTCGCTCCCGGC
CAAATGAGAGAGCCCAGAGGAAGCGATATCGCTGGCACAACCCTCAGGCCCATGACATATAAGGCCGCTATTGACC
TCAGCTTGTTTCTGAAAGAGAAAGGCGGACTGGAAGGCCTCATCTATAGCAAGAAAGCTGCTATGGAACAGGCTCC
CGAAGACCAAAGCCCTCAGAGAGAGCCTTACAATGAGTGGACCCTGGAGCTCCTGGAAGAGCTCAAGAAAGAGGCT
CAAGGCCAATGGACCTACCAAATCTTTCAGGAACCCTTTAAGAATCTGAAAACCGGAAAGTATTCCAGAATGAGAA
GCGCTCACACAAACTGGATGACAGAAACCCTCCTGGTCCAGAATGCCAATCCCGATTGCAAGTCCATCCTCAGGGC
TCTGGGAACCGGAGCCACACTGGAAGAGCCTGAGGTCATCCCTATGTTCTCAGCCCTCAGCGAAGGCGCTACCCCC
CAAGACCTGAATACGATGCTCAACATCGTCAGCGGACACCAATCCACCCTCCAGGAACAGATTGGCTGGATGACAA
ATAACCCTCCCATCCCTGTCGGAGAGATTTACAAAAGGTGGATTATCCTCGGCCTGACTAGAATCCCCCATCCCGC
CGGCCTCAAGAAAAGAAAAGCGTCACCGTCCTGGATGTGGGAGACGCTTACTTCAGCGTCCCCCTCGACGAAGAC
CAAAAGGAAACCTGGGAGGCTTGGTGGACGGAATACTGGCAGGCTACCTGGATTCCTGAGTGGGAGTTTGTGAATA
CCCCTCCCCTCGTGTTTCCCGATTGGCATAACTATACCCCTGGCCCTGGCATAAGGTATCCCCTCACCTTTGGATG
GTGCTTTAAGCTCGTGCCTGTGGACCCCAAACTGTGGTACCAACTGGAAAAGGAACCCATTGTCGGAGCCGAAACC
TTTTACGTGGACGGAGCCGCCAACAGAGAGACAAAGCTCGGCCAAAACGTCCAGGGACAGATGGTGCATCAGGCTA
TTAGCCCCAGGACCCTCAACGCTTGGGTCAAGGTCGTCGAAGAGAAAGCCTTTAACGAAACCGAAGTGCATAACGT
CTGGGCTACCCATGCCTGTGTGCGTACCGATCCCAATCCCCAAGAGATTCTCCTGGAGAATGTGACAGAGCTCAAG
GATCAGAAACTCCTCGGCATTTGGGGATGCTCCGGCAAAATCATTTGCACAACCACTGTGCCTTGGAACAGCTCCT
GGTCCAACCAAGCTGGCCATAACAAAGTGGGAAGCCTCCAGTATCTGGCTCTGACGGCTCTGATTAAGCCTAAGAA
AATCAAACCCCCTCTGCCTAGCGTTAAGACAATCATTGTGCATCTGAATGAGTCCGTGGAAATCAATTGCACAAGG
CCTAACAATAACACAAGGAAAGCCGCCGCTAGTGAAGTACGGAATAAGTCCAAACAGAAAACCCAGCAAGCTGCCG
CCGATACAGGCGACTCCAGCCAGGTCAGCCAAAACTATCCCATTGTGTCCAACTTTACCTCCACCACTGTGAAAGC
CGCTTGTTGGTGGGCCAATATCAAACAGGAGTTTGGAATCCCTTACAATCCCCAAAGCCAAACATTCTATGTGGAT
GGCGCTGCCAATAGGGAAACCCAACTGGGAAAGGCGGGCTATGTGACAGACAAAGGCAGACAGAAAGTCATTAGCG
GAATCTGGCAGCTCGACTGTACCCATCTGGAAGGCAAAGTCATTCTGGTAGCCGTCCACGTCGCCTCCGGCTACAT
TGAGGCTGAGGTCGGCAATGAGCAAGTGGATAAGCTCGTGAGTTCCGGAATCAGAAAGGTGCTATTCCTCGACGGA
ATCAATAAGGCTCAGGAAGAGCACGAAGTCAGGGAAAGGATTAGGCGAACCGCTCCCGCTGCTGAAGGCGTCGGCG
CTGTCTCCCAGGATCTGGATAAGTACGGAGCCCTCACCTCCACAAGCGGAACCCAACAGTCCCAGGGAACTGAAAC
TGGCGTCGGCAACCCTCAGATTTTGGGAGAGTCCAGCGTTGTCCTCGGCTCCGGCTCCATCGTCATCTGGGGTAAA
ACCCCTAAGTTTAAGTTCCCCATTCAGAAAGAGACATGGGAAGCCTGGTGGACGGAGTATTGGCAAGCCGCTGCTT
ACAGACTGATCAGCTGTAACACAAGCGTTATCAAACAGGCTTGCCCTAAGATTACCTTTGACCCTATCCCTATCCA
TTACTGTGCCCCTCCTAGCTGGATGGGCTATGAGCTCCACCCTGACAGATGGACAGTGCAACCCATCGTGCTCCCC
GAAAAGGACTCCTGGACAGTGAATGACATTCAGAAATCAATTCTGAGAGCCCTCGGCCCAGGCGCTTCCCTGGAGG
AAATGATGACAGCATGTCAGGGAGTGGGAGGCCCTGGCCATAAGGCTAGAGTGTATTACAGAGACTCCAGGGACCC
CATTTGGAAAGGCCCTGCCAAACTGCTCTGGAAAGGCGAAGGCGCTGTGGTCATCCAAGACATTAAGATTGGAGGC
CAACTGATAGAAGCCCTCCTGGATACAGGAGCCGATGACACCGTCCTGGAAGATATGAATCTGCCTGGCAAGTGGG
GAATCAAACAGCTCCAGGCTAGGGTCCTGGCTATCGAGAGGTATCTGAAAGATCAACAGTTTCTGGGACTCTGGGG
CTGTAGCGGAAAGGCTGCTATGGAAAACAGATGGCAAGTGATGATCGTCTGGCAAGTGGACAGGATGAAGATTAGG
```

Figure 30 (Cont)

```
ACATGGAATAGCCTCGTGAAACACCATATGTATATTATCTGTACCACAACCGTCCCCTGGAACTCCACCTGGAGCA
ATAAGTCCTTCGAAGAGATTTGGAATAACATGACCTGGATTCAATGGCTGATTCTCGCTATCGTCGTGTGGACCAT
TGTGTATATCGAATACAAGAAACTGCTCAGGCAAAGGAGAATCGATAGGCTCATCAAAAGGCTCAACCCTGGCCTC
CTGGAAACCGCTGAGGGATGTAAACAGATCCTGGAACAGCTCCAGCCCGCCCTCCAGACAGGCACCGAAGAGCTCT
CTAGTAGAAAGCTCCTGAAACAGAGAAAGATTGACAGACTGATTGAGAGAATCAGAGAGAGAGCCGAAGACTCCGG
CAATGAGTCCGAGGGAGACACACCCGGAATCAGATACCAATACAATGTGCTCCCCAAGGCTGGAAGGGCTCCCCA
CCCATTTTCCAAAGCTCCATGACCCAAATCCTCATGATGCAAAGGGGAAACTTTAAGGGACAGAAAAGGATTATCA
AGTGCTTCAACTGTGGAAAGGAAGGCCATCTCGCTAGGAATTGCAGACCTCCCCTAGAGAGACTGAACCTGGATTG
CTCCGAGGATAGCGACACCTCCGGCACACAGCAAAGCCAAGGCACAGAGACAGAAGTGGGACTCGTGGCTGTGCAT
GTGGCCAGCGGATATATCGAAGCCGAAGTGATCCCTGCCGAAACTGGACAGGAAACCGCTTACTTTATCCTCAAGA
TTAAGCCTGTGGTCAGCACACAGCTCCTGCTCAACGGTAGCCTCGCTGAAGAGGAAATCATTATCAGAAGCGAAAA
CTTTACCGATAACAAACTGGTCGGCAAACTGAATTGGGCTTCCAAATCTACGCTGGCATCAAAGTGAAGCAACTG
TGTAAGCTCCTGAGAGGCACCAAAGCCCTCACTCCTCTGTGTGTGACACTGAATTGCACAAACGCTAACCTCATCA
ATGTGAATGCTGCTCAAACCAGAGGCGATAACCCTACCGGTCCCGAAGAGTCCAAGAAAGAGGTCGCGTCCAAGAC
AGAGACAGACCCTTGTGACGCCGCCCCTAGCTCCAACTTTCTGGGAAGGTCTGCCGAACCCGTCCCCTCCAGCCC
CCCCCTCTGGAAAGGCTCCACCTCGACTGTAGCGAAGACTGTGGCGAACTGGATAAGTGGGCCTCCCTGTGGAACT
GGTTCAATATCACCAACTGGCTGTGGTACATTAAGATTTTCATTATGATTGTGGGAGGCAATAAGATTGTCAGGAT
GTACTCACCTGTCTCCATCCTCGACATTAAGCAAGGCCCTAAGGAACCCTTCAGGGATTACGTGGACAGATTCGCT
AAGCTCCTGTGGAAGGGAGAGGGAGCCGTCGTGATTCAGGACAACTCCGACATTAAGGTCGTGCCCAGGAGAAAGG
CTAAGATTATCGAACTGAATAAGAGAACCCAAGACTTTTGTGAAGTGCAACTGGGAATCCCTCACCCTGCTGGACT
GAAGAAGAAAAAGTCAGTGACAGTGGCCGCTATGAGAGTGAAAGAGACACAGATGAACTGGCCCAATCTGTGGAAG
TGGGGCACAATGATTCTGGGACTGGTCATCATTTGCTCCGCCTCCATTAAGGTCAGACAGCTCTGCAAACTGCTCA
GGGTACAAAGGCTCTGACAGAGATTGTGACACTGACAGAGGAAGCCGAACTGGAACTGCTCATATGGAAGTTTGA
CTCCCGCCTCGCCCTGAGACATATCGCCAGGGAACTGCATCCCGAGTTCTACAAAGACTGCGCTGCTGTCGAGCTC
CTGGGACGCTCCAGCCTCAAGGGACTGCAAAGGGGATGGGAAGGCCTCAAGTATTTGTGGAACCTCCTGCAGTATT
GGGGCTCTAGCCTGGGGCAACTGCAACCTGCTCTGAAAACCGGATCAGAGGAACTGAAGTCCCTGTATAACACAAT
CGCTACCCTCTGGTGTGTGCATCAGGAGCTCTACAAATACAAAGTGGTCAAAATCAAACCCCTCGGCATTGCCCCT
ACCAGAGCCAAAAGGAGAGTGGTCGAGAGAGAGAAAAGGCTCACCGAAATCGTCCCACTCACCGAAGAGGCTGAGC
TGGAGCTGGAGGAAAACAGAGAGATTCTGAGGGAACCCGTCCACGGAGTGTATAGAGTGCTCGCCGAAGCCATGAG
CCAAGTCAACAATGCCAACATCATGATGCAGAGAGGCAATTTCAAAGGCCTAAAGAGAATCATCAAACAAGAGGAA
GAGGAGGTCGGCTTCCCCGTCAGGCCCCAGGTCCCACTGAGACCTATGACCTACAAAGGAGCCGTCGATCTGTCCT
TCTTCAGACAGGGACCCAAAGAGCCTTTCAGAGACTATGTGGATAGGTTTTTCAAAACCCTCAGGGCTGAGCAAGC
CTCACAGGAAGTGAAAAACTGGAGAAAATCAGACTGAGACCTGGTGGCAAAAAGAAATACAAAATGAAACACATT
GTGTGGGCCTCCAGGGAACTGGAAAGGTTTGCCTCCCAGTATGCCCTCGGCATCATCCTAGCCCAACCCGATAAGT
CCGAGTCCGAGCTCGTGAATCAGATTATCGAAGAGCTCATCAAGAAGATTGCCGTCGCCGGATGGACAGACAGAAT
CATTGAGGTCGACCAAAGGGCTTGGAGAGCCATTCTGAATATCCCCAGGAGAATCAGACAGACTAGACTCGCCGGA
AGGTGGCCCGTCAGGACAATCTATACCGATAACGGAAGCAATTTCACAAGCGCTACCGTCAAGGCTGCCTGCTGGT
GGGCTGATGTGAAACAGCTCACCGCAGTCGTCCAGAAAATCGCTACCGAAAGCATTGTGATATGGGGAAAGACGCC
CAAGTTCAGACTGCCTATCGCTGCCGCCAGCAACGAGAACATGGAGACCATGGCTGCTtgaagatctgaattc
```

Figure 30 (Cont)

C2 fragment
ggatccaccATGCTCGAGAGCAACACAGCCGCTAACAATACCGATTGCGTGTGGCTGAAAGCCCAGGAAGAGGAAG
AAGTGGGATTTCCTGTGAGACCCCAAGTGCCTAGAGCCGGGAGGGCTATCCTCAACATTCCCACGAGGATTAGGCA
AGGCCTTGAGAGAGCCCTCCTAGCCGCCGAATGGGATAGGATTCACCCTGTGCACGCTGGCCCTATCGCTCCCGGC
CAAATGAGAGAGCCCAGGGGAAGCGATATCGCTGGCACAACCCTCAGGCCCATGACATATAAGGCCGCTATTGACC
TCAGCTTGTTTCTGAAAGAGAAAGGCGGACTGGATGGCCTCATCTATAGCAAGAAAGCTGCTATGGAACAGGCTCC
CGAAGACCAAAGCTCTCAGAGAGAGCCTTACAATGAGTGGACCCTGGAGCTCCTGGAAGAGCTCAAGCACGAGGCT
CAAGGCCAATGGACCTTCCAAATCTTTCAGGAACCCTTTAAGAATCTGAAAACCGGAAAGTATGCCAGAATGAGAG
GCGCTCACACAAACTGGATGACAGATACCCTCCTGGTCCAGAATGCCAATCCCGATTGCAAGTCCATCCTCAAGGC
TCTGGGACCCGGAGCCTCACTGGAAGAGCCTGAGGTCATCCCTATGTTCTCAGCCCTCAGCGAAGGCGCTACCCCC
CAAGACCTGAATATGATGCTCAACACCGTCGGCGGACACCAATCCACCCTCCAGGAACAGATTGGCTGGATGACAA
ATAACCCTCCCATCCCTGTCGGAGAGATTTACAAAAGGTGGATTATCCTCGGCCTGACTAGAATCCCCCATCCCGC
CGGCCTCAAGAAAAAGAAAAGCGTCACCGTCCTGGATGTGGGAGACGCTTACTTCAGCGTCCCCCTCGACGAAGGC
CAAAGGGAAACCTGGGAGGCTTGGTGGATGGAATACTGGCAGGCTACCTGGATTCCTGAGGGGGAGTTTGTGAATA
CCCCTCCCCTCGTGTTTCCCGATTGGCAAAACTATACCCCTGGCCCTGGCACAAGGTATCCCCTCACCTTTGGATG
GTGCTTTAAGCTCGTGCCTGTGGACCCCAAACTGTGGTACCAACTGGAAAAGGACCCCATTGTCGGAGTCGAAACC
TTTTACGCGGACGGAGCCGCCAACAGAGAGACAAAGCTCGGCCAAAACGTCCAGGGACAGATGGTGCATCAGCCTA
TTAGCCCCAGGACCCTCAACGCTTGGGTCAAGGTCATCGAAGAGAAAGGCTTTAGCGACACCGAAGTGCATAACGT
CTGGGCTACCCATGCCTGTGTGCCTACCGATCCCAATCCCCAAGAGATTCTCCTGGAGAATGTGACAGAGCTCAAG
GATCAGAAACTCCTCGGCATTTGGGGATGCTCCGGCAAACTCATTTGCACAACCACTGTGCCTTGGAACAGCTCCT
GGTCCAACCCAGCTGGCCATAACAAAGTGGGAAGCCTCCAGTATCTGGCTCTGAAGGCTCTGATTACGCCTAAGAA
AATCAAACCCCCTCTGCCTAGCGTTAAGACAATCATTGTGCATCTGAATGAGTCCGTGGAAATCAATTGCACAAGG
CCTAACAATAACACAAGGACAGCCGCCGCTAGTGAAGTACAGAATAAGTCCAGACAGAAAACCCAGCAAGCCGCCG
CCGATACAGGCAGCTCCAGCAAGGTCAGCCAAAACTATCCCATTGTGTCCAACTTTACCTCCACCACTGTGAAAGC
CGCTTGTTGGTGGGCCAATATCAAACAGGAGTTTGGAATCCCTTACAATCCCCAAAGCCGAACATTCTATGTGGAT
GGCGCTGCCAATAGGGAAACCAAACTGGGAAAGGCTGGCTATGTGACAGACAGAGGCAGACAGAAAGTCGTTAGCG
GAATCTGGCAGCTCGACTGTACCCATCTGAAAGGCAAAGTCATTCTGGTAGCCGTCCACGTCGCCTCCGGCTACAT
TGAGGCTGAGGTCGGCAATGAGCAAGTGGATAAGCTCGTGATTTCCGGAATCAGAAAGGTGCTATTCCTCGACGGA
ATCGATAAGGCTCAGGAAGAGCACGAAGTCAGGGAAAGGATTAGGCGAGCCGCTCCCGCTGCTGAAGGCGTCGGCG
CTGTCTCCCAGGATCTGGATAAGTACGGAGCCATCACCTCCACAAGCGGAACCCAACAGTCCCAGGGAACTGAAAC
TGGCGTCGGCAACCCTCAGATTTTGGGAGAGTCCAGCGCTGTCCTCGGCTCCGGCTCCATCGTCATCTGGGGTAAA
ACCCCTAAGTTTAAGCTCCCCATTCAGAAAGAGACATGGGAAACCTGGTGGATGGACTATTGGCAAGCCGCTGCTT
ACAGACTGATCAGCTGTAACACAAGCGTTATCACACAGGCTTGCCCTAAGATTAGCTTTGAGCCTATCCCTATCCA
TTACTGTGCCCCTCCTAGCTGGATGGGCTATGAGCTCCACCCTGACAGATGGACAGTGCAACCCATCGTGCTCCCC
GAAAAGGAGTCCTGGACAGTGAATGACATTCAGAAAACAATTCTGAAAGCCCTCGGCCCAGGCGCTACCCTGGAGG
AAAATATGACAGCATGTCAGGGAGTGGGAGGCCCTGGCCATAAGGCTAGAGTGTATTACAGAGACTCCAGGGACCC
CATTTGGAAAGGCCCTGCCAAACTGCTCTGGAAAGGCGAAGGCGCTGTGGTCATCCAAGACATTAAGATTGGAGGC
CAACTGAAAGAAGCCCTCCTGGATACAGGAGCCGATGACACCGTCCTGGAAGATATCAATCTGCCTGGCAAGTGGG
GAATCAAACAGCTCCAGGCTAGGGTCCTGGCTATCGAGAGGTATCTGAAAGATCAACAGCTTCTGGGAATCTGGAG
CTGTAGCGGAAAGGCTGCTATGGAAAACAGATGGCAAGTGATGATCGTCTGGCAAGTGGACAGGATGAAGATTAGG

Figure 30 (Cont)

```
ACATGGAATAGCCTCGTGAAACACCATATGTATCTTATCTGTACCACAGCCGTCCCCTGGAACTCCACCTGGAGCA
ATAAGTCCTTCGAAGAGATTTGGAATAACATGACCTGGATTGAATGGCTGATTATCGCTATCGTCGTGTGGACCAT
TGTGTTTATCGAATACAAGAAACTGCTCAGGCAAAGGAAAATCGATAGGCTCATCGAAAGGCTCAACCCTGGCCTC
CTGGAAACCGCTGAGGGATGTAAACAGATCCTGGAACAGCTCCAGCCCGCCCTCAAGGCAGGCACCGAAGAGCTCT
CTAGTAGAAAGCTCCTGAGACAGAGAAAGATTGACAGACTGATTGAGAGAATCAGAGAGAGAGCCGAAGACTCCGG
CAATGAGTCCGAGGGAGACACACCCGGAATCAGATACCAATACAATGTGCTCCCCCAAGGCTGGAAGGGCTCCCCA
GCCATTTTCCAAAGCTCCATGACCAAAATCCTCATGATGCAAAGGGGAAACTTTAAGGGACAGAAAAGGATTATCA
AGTGCTTCAACTGTGGAAAGGAAGGCCATCTCGCTAGGAATTGCAGACCTCCCCTGGAGAGACTGAACCTGGATTG
CTCCGAGGATAGCGACACCTCCGGCACACAGCAAAGCCAAGGCACAGAGACAGGAGTGGGACTCGTGGCTGTGCAT
GTGGCCAGCGGATATATCGAAGCCGAAGTGATCCCTGCCGAAACTGGACAGGAAACCGCTTACTTTCTCCTCAAGA
TTAAGCCTGTGGTCAGCACACAGCTCCTGCTCAACGGTAGCCTCGCTGAAGAGGAAATCATTATCAGAAGCGAAAA
CTTTACCAATAACAAACTGGTCGGCAAACTGAATTGGGCTTCCCAAATCTACCCTGGCATCAAAGTGAGGCAACTG
TGTAAGCTCCTGAGAGGCACCAAAGCCCTCACCCCTCTGTGTGTGACACTGAATTGCACAAACGCTAACCTCATCA
ATGTGAATGCTGCTCAACCCAGAGGCGATAACCCTACCGATCCCAAAGAGTCTAAGAAAGAGGTCGCGTCCAAGGC
AGAGACAGACCCTTTTGACGCCGCCCCTAGCTCCACCTTTCTGGGAAGGTCTGTCGAACCCGTCCCCCTCCAGCTC
CCCCCTCTGGAAAGGCTCCACCTCGACTGTAGCGAAGACAGTGACGAACTGGATAAGTGGGCCTCCCTGTGGAACT
GGTTCAATATCACCAACTGGCTGTGGTACATTAAGATTTTCATTATGATTGTGGGAGGCAATAAGATTGTCAGGAT
GTACCAACCTGTCTCCATCCTCGACATTAAGCAAGGCCCTAAGGAACCCTTCAGGGATTACGTGGACAGATTCGCT
AAGCTCCTGTGGAAGGGAGAGGGAGCCGTCGTGATTCAGGACAACTCCGACATTAAGGTCGTGCCCAGGAGAAAGG
CTAAGATTATCGAACTGAATAAGAGAACCCAAGACTTTTGGGAAGCGCAACTGGGAATCCCTCACCATGCTGGACT
GAAAAAGAAAAAGTCCGTGACAGTGGCCGCTATGAGAGTGAAAGAGACACAGATGAACTGGCCCAATCTGTGGAAG
TGGGGCACAATGATTCTGGGACTGGTCATCATTTGCTCCGCCTCCATTAAGGTCAAACAGCTCTGCAAACTGCTCA
GGGGTGCAAAGGCTCTGATAGACATTGTGCCACTGACAGAGGAAGCCGAACTGGAACTGCTCATATGGAAGTTTCA
CTCCCACCTCGCCCTGAGACATATCGCCAGGGAACTGCATCCCGAGTACTACAAAGACTGCGCTGCTGTCGAGCTC
CTGGGACGCTCCAGCCTCAAGGAACTGCGAAGGGGATGGGAAGCCCTCAAGTATTTGTGGAACCTCCTGCAGTATT
GGGGCTCTAGCCTGGAGCAACTGCAATCTGCTCTGAAAACCGGATCAGAGGAACTGAGGTCCCTGTTTAACACAGT
CGCTACCCTCTGGTGTGTGCATCAGGAGCTCTACAAATACAAAGTGGTCAAAATCGAACCCCTCGGCATTGCCCCT
ACCAAAGCCAAAAGGAGAGTGGTCCAGAGAGAGAAAAGGCTCACCGATATCGTCACACTCACCGAAGAGGCTGAGC
TGGAGCTGGAGGAAAACAGAGAGATTCTGAAGGAACCCGTCCACGGAGTGTATAGAGTGCTCGCCGAAGCCATGAG
CCAAGCCAACAATGCCAACATCATGATGCAGAGAGGCAATTTCAGAGGCCCAAAGAGAATCATCAAACAAGAGGAA
GAGGGGGTCGGCTTCCCCGTCAGGCCTCAGGTCCCACTGAGACCTATGACCTACAAAGCAGCCATCGATCTGTCCT
TCTTCAAACAGGGACCCAAAGAGCCTTTCAGAGACTATGTGGATAGGTTTTTCAAAACCCTCAGGGCTGAGCAAGC
CTCACAGGAAGTGAAAAACTGGGAGAAAATCAGACTGAGATCTGGTGGCAAAAAGAAATACAAACTGAAACACATT
GTGTGGGCCTCCAGGGAACTGGAAAGGTTTGCCTCCCAGTATGCCCTCGGCATCATCCTAGCCCAACCCGATAAGT
CCGAGTCCGAGCTCGTGAGTCAGATTATCGAAGAGCTCATCAAGAAGATTGCCGTCGCCGGATGGACAGACAGAGT
CATTGAGGTCGTCCAAAGGGCTTGGAGAGCCATTCTGAATATCCCCAGGAGAATCAGACAGACTAGACTCGCCGGA
AGGTGGCCCGTCAAGATAATCCATACCGATAACGGAAGCAATTTCACAAGCACTGCCGTCAAGGCTGCCTGCTGGT
GGGCTGATGTGAAACAGCTCACCGAAGTCGTTCAGAAAATCGCTACCGAAAGCATTGTGATATGGGAAAGACACC
CAAGTTCAGACAGCCTATCGCTGCCGCCAGCAACGAGAACATGGACGCCATGGCTGCTtgaagatctgaattc
```

Figure 30 (Cont)

SYNTHETIC PEPTIDES AND USES THEREFORE

CROSS-REFERENCE TO RELATED APPLICATIONS

This is the U.S. National Phase under 35 U.S.C. §371 of International Application No. PCT/AU01/00622, filed May 25, 2001, designating the United States and published in English, which claims priority to Australian Application No. PQ 7761, filed May 26, 2000, the disclosure of which is herein incorporated by reference in its entirety.

FIELD OF THE INVENTION

THIS INVENTION relates generally to agents for modulating immune responses. More particularly, the present invention relates to a synthetic polypeptide comprising a plurality of different segments of a parent polypeptide, wherein the segments are linked to each other such that one or more functions of the parent polypeptide are impeded, abrogated or otherwise altered and such that the synthetic polypeptide, when introduced into a suitable host, can elicit an immune response against the parent polypeptide. The invention also relates to synthetic polynucleotides encoding the synthetic polypeptides and to synthetic constructs comprising these polynucleotides. The invention further relates to the use of the polypeptides and polynucleotides of the invention in compositions for modulating immune responses. The invention also extends to methods of using such compositions for prophylactic and/or therapeutic purposes.

Bibliographic details of various publications referred to in this specification are collected at the end of the description.

BACKGROUND OF THE INVENTION

The modem reductionist approach to vaccine and therapy development has been pursued for a number of decades and attempts to focus only on those parts of pathogens or of cancer proteins which are relevant to the immune system. To date the performance of this approach has been relatively poor considering the vigorous research carried out and the number of effective vaccines and therapies that it has produced. This approach is still being actively pursued, however, despite its poor performance because vaccines developed using this approach are often extremely safe and because only by completely understanding the immune system can new vaccine strategies be developed.

One area that has benefited greatly from research efforts is knowledge about how the adaptive immune system operates and more specifically how T and B cells learn to recognise specific parts of pathogens and cancers. T cells are mainly involved in cell-mediated immunity whereas B cells are involved in the generation of antibody-mediated immunity. The two most important types of T cells involved in adaptive cellular immunity are $\alpha\beta$ CD8$^+$ cytotoxic T lymphocytes (CTL) and CD4$^+$ T helper lymphocytes. CTL are important mediators of cellular immunity against many viruses, tumours, some bacteria and some parasites because they are able to kill infected cells directly and secrete various factors which can have powerful effects on the spread of infectious organisms. CTLs recognise epitopes derived from foreign intracellular proteins, which are 8-10 amino acids long and which are presented by class I major histocompatibility complex (MHC) molecules (in humans called human lymphocyte antigens—HLAs) (Jardetzky et al., 1991; Fremont et al., 1992; Rotzschke et al., 1990). T helper cells enhance and regulate CTL responses and are necessary for the establishment of long-lived memory CTL. They also inhibit infectious organisms by secreting cytokines such as IFN-$\gamma$. T helper cells recognise epitopes derived mostly from extracellular proteins which are 12-25 amino acids long and which are presented by class II MHC molecules (Chicz et al., 1993; Newcomb et al., 1993). B cells, or more specifically the antibodies they secrete, are important mediators in the control and clearance of mostly extracellular organisms. Antibodies recognise mainly conformational determinants on the surface of organisms, for example, although sometimes they may recognise short linear determinants.

Despite significant advances towards understanding how T and linear B cell epitopes are processed and presented to the immune system, the full potential of epitope-based vaccines has not been fully exploited. The main reason for this is the large number of different T cell epitopes, which have to be included into such vaccines to cover the extreme HLA polymorphism in the human population. The human HLA diversity is one of the main reasons why whole pathogen vaccines frequently provide better population coverage than subunit or peptide-based vaccine strategies. There is a range of epitope-based strategies though which have tried to solve this problem, e.g. peptide blends, peptide conjugates and polyepitope vaccines (ie comprising strings of multiple epitopes) (Dyall et al., 1995; Thomson et al., 1996; Thomson et al., 1998; Thomson et al., 1998). These approaches however will always be sub optimal not only because of the slow pace of epitope characterisation but also, because it is virtually impossible for them to cover every existing HLA polymorphism in the population. A number of strategies have sought to avoid both problems by not identifying epitopes and instead incorporating larger amounts of sequence information e.g., approaches using whole genes or proteins and approaches that mix multiple protein or gene sequences together. The proteins used by these strategies however sometimes still function and therefore can compromise vaccine safety e.g. whole cancer proteins. Alternative strategies have tried to improve the safety of vaccines by fragmenting the genes and expressing them either separately or as complex mixtures e.g., library DNA immunisation or by ligating such fragments back together. These approaches are still sub-optimal because they are too complex, generate poor levels of immunity, cannot guarantee that all proteins no longer function and/or that all fragments are present, which compromises substantially complete immunological coverage.

The lack of a safe and efficient vaccine strategy that can provide substantially complete immunological coverage is an important problem, especially when trying to develop vaccines against rapidly mutating and persistent viruses such as HIV and hepatitis C virus, because partial population coverage could allow vaccine-resistant pathogens to re-emerge in the future. Human immunodeficiency virus (HIV) is an RNA lentivirus virus approximately 9 kb in length, which infects CD4$^+$ T cells, causing T cell decline and AIDS typically 3-8 years after infection. It is currently the most serious human viral infection, evidenced by the number of people currently infected with HIV or who have died from AIDS, estimated by the World Health Organisation (WHO) and UNAIDS in their AIDS epidemic update (December 1999) to be 33.6 and 16.3 million people, respectively. The spread of HIV is also now increasing fastest in areas of the world where over half of the human population reside, hence an effective vaccine is desperately needed to curb the spread of this epidemic. Despite the urgency, an effective vaccine for HIV is still some way off because of delays in defining the correlates of immune protection, lack of a suitable animal model, existence of up to 8 different subtypes of HIV and a high HIV mutation rate.

A significant amount of research has been carried out to try and develop a vaccine capable of generating neutralising antibody responses that can protect against field isolates of HIV. Despite these efforts, it is now clear that the variability, instability and inaccessibility of critical determinants on the HIV envelope protein will make it extremely difficult and perhaps impossible to develop such a vaccine (Kwong et al., 1998). The limited ability of antibodies to block HIV infection is also supported by the observation that development of AIDS correlates primarily with a reduction in CTL responsiveness to HIV and not to altered antibody levels (Ogg et al., 1998). Hence CTL-mediated and not antibody-mediated responses appear to be critical for maintaining the asymptomatic state in vivo. There is also some evidence to suggest that pre-existing HIV-specific CTL responses can block the establishment of a latent HIV infection. This evidence comes from a number of cases where individuals have generated HIV-specific CTL responses without becoming infected and appear to be protected from establishing latent HIV infections despite repeated virus exposure (Rowland-Jones et al., 1995; Parmiani 1998). Taken together, these observations suggest that a vaccine capable of generating a broad range of strong CTL responses may be able to stop individuals from becoming latently infected with HIV or at least allow infected individuals to remain asymptomatic for life. Virtually all of the candidate HIV vaccines developed to date have been derived from subtype B HIV proteins (western world subtype) whereas the majority of the HIV infections worldwide are caused by subtypes A/E or C (E and A are similar except in the envelop protein)(referred to as developing world subtypes). Hence existing candidate vaccines may not be suitable for the more common HIV subtypes. Recently, there has been some evidence that B subtype vaccines may be partially effective against other common HIV subtypes (Rowland-Jones et al., 1998). Accordingly, the desirability of a vaccine still remains, whose effectiveness is substantially complete against all isolates of all strains of HIV.

SUMMARY OF THE INVENTION

The present invention is predicated in part on a novel strategy for enhancing the efficacy of an immunopotentiating composition. This strategy involves utilising the sequence information of a parent polypeptide to produce a synthetic polypeptide that comprises a plurality of different segments of the parent polypeptide, which are linked sequentially together in a different arrangement relative to that of the parent polypeptide. As a result of this change in relationship, the sequence of the linked segments in the synthetic polypeptide is different to a sequence contained within the parent polypeptide. As more fully described hereinafter, the present strategy is used advantageously to cause significant disruption to the structure and/or function of the parent polypeptide while minimising the destruction of potentially useful epitopes encoded by the parent polypeptide.

Thus, in one aspect of the present invention, there is provided a synthetic polypeptide comprising a plurality of different segments of at least one parent polypeptide, wherein the segments are linked together in a different relationship relative to their linkage in the at least one parent polypeptide.

In one embodiment, the synthetic polypeptide consists essentially of different segments of a single parent polypeptide.

In an alternate embodiment, the synthetic polypeptide consists essentially of different segments of a plurality of different parent polypeptides.

Suitably, said segments in said synthetic polypeptide are linked sequentially in a different order or arrangement relative to that of corresponding segments in said at least one parent polypeptide.

Preferably, at least one of said segments comprises partial sequence identity or homology to one or more other said segments. The sequence identity or homology is preferably contained at one or both ends of said at least one segment.

In another aspect, the invention resides in a synthetic polynucleotide encoding the synthetic polypeptide as broadly described above.

According to yet another aspect, the invention contemplates a synthetic construct comprising a said polynucleotide as broadly described above that is operably linked to a regulatory polynucleotide.

In a further aspect of the invention, there is provided a method for producing a synthetic polynucleotide as broadly described above, comprising:

linking together in the same reading frame a plurality of nucleic acid sequences encoding different segments of at least one parent polypeptide to form a synthetic polynucleotide whose sequence encodes said segments linked together in a different relationship relative to their linkage in the at least one parent polypeptide.

Preferably, the method further comprises fragmenting the sequence of a respective parent polypeptide into fragments and linking said fragments together in a different relationship relative to their linkage in said parent polypeptide sequence. In a preferred embodiment of this type, the fragments are randomly linked together.

Suitably, the method further comprises reverse translating the sequence of a respective parent polypeptide or a segment thereof to provide a nucleic acid sequence encoding said parent polypeptide or said segment. In a preferred embodiment of this type, an amino acid of said parent polypeptide sequence is reverse translated to provide a codon, which has higher translational efficiency than other synonymous codons in a cell of interest. Suitably, an amino acid of said parent polypeptide sequence is reverse translated to provide a codon which, in the context of adjacent or local sequence elements, has a lower propensity of forming an undesirable sequence (e.g., a palindromic sequence or a duplicated sequence) that is refractory to the execution of a task (e.g., cloning or sequencing).

In another aspect, the invention encompasses a computer program product for designing the sequence of a synthetic polypeptide as broadly described above, comprising:

code that receives as input the sequence of at least one parent polypeptide;

code that fragments the sequence of a respective parent polypeptide into fragments;

code that links together said fragments in a different relationship relative to their linkage in said parent polypeptide sequence; and a computer readable medium that stores the codes.

In yet another aspect, the invention provides a computer program product for designing the sequence of a synthetic polynucleotide as broadly described above, comprising:

code that receives as input the sequence of at least one parent polypeptide;

code that fragments the sequence of a respective parent polypeptide into fragments;

code that reverse translates the sequence of a respective fragment to provide a nucleic acid sequence encoding said fragment;

code that links together in the same reading frame each said nucleic acid sequence to provide a polynucleotide sequence that codes for a polypeptide sequence in which said fragments are linked together in a different relationship relative to their linkage in the at least one parent polypeptide sequence; and a computer readable medium that stores the codes.

In still yet another aspect, the invention provides a computer for designing the sequence of a synthetic polypeptide as broadly described above, wherein said computer comprises:
(a) a machine-readable data storage medium comprising a data storage material encoded with machine-readable data, wherein said machine-readable data comprise the sequence of at least one parent polypeptide;
(b) a working memory for storing instructions for processing said machine-readable data;

(c) a central-processing unit coupled to said working memory and to said machine-readable data storage medium, for processing said machine readable data to provide said synthetic polypeptide sequence; and (d) an output hardware coupled to said central processing unit, for receiving said synthetic polypeptide sequence.

In a preferred embodiment, the processing of said machine readable data comprises fragmenting the sequence of a respective parent polypeptide into fragments and linking together said fragments in a different relationship relative to their linkage in the sequence of said parent polypeptide.

In still yet another aspect, the invention resides in a computer for designing the sequence of a synthetic polynucleotide as broadly described above, wherein said computer comprises:
(a) a machine-readable data storage medium comprising a data storage material encoded with machine-readable data, wherein said machine-readable data comprise the sequence of at least one parent polypeptide;
(b) a working memory for storing instructions for processing said machine-readable data;

(c) a central-processing unit coupled to said working memory and to said machine-readable data storage medium, for processing said machine readable data to provide said synthetic polynucleotide sequence; and (d) an output hardware coupled to said central processing unit, for receiving said synthetic polynucleotide sequence.

In a preferred embodiment, the processing of said machine readable data comprises fragmenting the sequence of a respective parent polypeptide into fragments, reverse translating the sequence of a respective fragment to provide a nucleic acid sequence encoding said fragment and linking together in the same reading frame each said nucleic acid sequence to provide a polynucleotide sequence that codes for a polypeptide sequence in which said fragments are linked together in a different relationship relative to their linkage in the at least one parent polypeptide sequence.

According to another aspect, the invention contemplates a composition, comprising an immunopotentiating agent selected from the group consisting of a synthetic polypeptide as broadly described above, a synthetic polynucleotide as broadly described above and a synthetic construct as broadly described above, together with a pharmaceutically acceptable carrier.

The composition may optionally comprise an adjuvant.

In a further aspect, the invention encompasses a method for modulating an immune response, which response is preferably directed against a pathogen or a cancer, comprising administering to a patient in need of such treatment an effective amount of an immunopotentiating agent selected from the group consisting of a synthetic polypeptide as broadly described above, a synthetic polynucleotide as broadly described above and a synthetic construct as broadly described above, or a composition as broadly described above.

According to still a further aspect of the invention, there is provided a method for treatment and/or prophylaxis of a disease or condition, comprising administering to a patient in need of such treatment an effective amount of an immunopotentiating agent selected from the group consisting of a synthetic polypeptide as broadly described above, a synthetic polynucleotide as broadly described above and a synthetic construct as broadly described above, or a composition as broadly described above.

The invention also encompasses the use of the synthetic polypeptide, the synthetic polynucleotide and the synthetic construct as broadly described above in the study, and modulation of immune responses.

BRIEF DESCRIPTION OF THE DRAWINGS

FIG. 3 is a diagrammatic representation showing overlapping segments of a parent polypeptide sequence for HIV gag [SEQ ID NO: 1] used for the construction of an embodiment of an HIV Savine. Also shown are the alignments of common HIV clade consensus sequences for the HIV gag protein from the HIV Molecular Immunology Database 1997, Editors Bette Korber, John Moore, Cristian Brander, Richard Koup, Barton Haynes and Bruce Walker. Publisher, Los Alamos National Laboratory, Theoretical Biology and Biophysics, Los Alamos, N.Mex., Pub LAUR 98-485.

FIG. 4 is a diagrammatic representation showing overlapping segments of a parent polypeptide sequence for HIV pol [SEQ ID NO: 2] used for the construction of an embodiment of an HIV Savine. Also shown are the alignments of common HIV lade consensus sequences for the HIV pol protein from the HIV Molecular Immunology Database 1997, Editors Bette Korber, John Moore, Cristian Brander, Richard Koup, Barton Haynes and Bruce Walker. Publisher, Los Alamos National Laboratory, Theoretical Biology and Biophysics, Los Alamos, N.Mex., Pub LAUR98-485.

FIG. 5 is a diagrammatic representation showing overlapping segments of a parent polypeptide sequence for HIV vif [SEQ ID NO: 3] used for the construction of an embodiment of an HIV Savine. Also shown are the alignments of common HIV clade consensus sequences for the HIV vif protein from the HIV Molecular Immunology Database 1997, Editors Bette Korber, John Moore, Cristian Brander, Richard Koup, Barton Haynes and Bruce Walker. Publisher, Los Alamos National Laboratory, Theoretical Biology and Biophysics, Los Alamos, N.Mex., Pub LAUR98-485.

FIG. 6 is a diagrammatic representation showing overlapping segments of a parent polypeptide sequence for HIV vpr [SEQ ID NO: 4] used for the construction of an embodiment of an HIV Savine. Also shown are the alignments of common HIV lade consensus sequences for the HIV vpr protein from the HIV Molecular Immunology Database 1997, Editors Bette Korber, John Moore, Cristian Brander, Richard Koup, Barton Haynes and Bruce Walker. Publisher, Los Alamos National Laboratory, Theoretical Biology and Biophysics, Los Alamos, N.Mex., Pub LAUR 98-485.

FIG. 7 is a diagrammatic representation showing overlapping segments of a parent polypeptide sequence for HIV tat [SEQ ID NO: 5] used for the construction of an embodiment of an HIV Savine. Also shown are the alignments of common HIV lade consensus sequences for the HIV tat protein from the HIV Molecular Immunology Database 1997, Editors Bette Korber, John Moore, Cristian Brander, Richard Koup, Barton Haynes and Bruce Walker. Publisher, Los Alamos National Laboratory, Theoretical Biology and Biophysics, Los Alamos, N.Mex., Pub LAUR 98-485.

FIG. 8 is a diagrammatic representation showing overlapping segments of a parent polypeptide sequence for HIV rev [SEQ ID NO: 6] used for the construction of an embodiment of an HIV Savine. Also shown are the alignments of common HIV lade consensus sequences for the HIV rev protein from the HIV Molecular Immunology Database 1997, Editors Bette Korber, John Moore, Cristian Brander, Richard Koup, Barton Haynes and Bruce Walker. Publisher, Los Alamos National Laboratory, Theoretical Biology and Biophysics, Los Alamos, N.Mex., Pub LAUR 98-485.

FIG. 9 is a diagrammatic representation showing overlapping segments of a parent polypeptide sequence for HIV vpu [SEQ ID NO: 7] used for the construction of an embodiment of an HIV Savine. Also shown are the alignments of common HIV lade consensus sequences for the HIV vpu protein from the HIV Molecular Immunology Database 1997, Editors Bette Korber, John Moore, Cristian Brander, Richard Koup, Barton Haynes and Bruce Walker. Publisher, Los Alamos National Laboratory, Theoretical Biology and Biophysics, Los Alamos, N.Mex., Pub LAUR 98-485.

FIG. 10 is a diagrammatic representation showing overlapping segments of a parent polypeptide sequence for HIV env [SEQ ID NO: 8] used for the construction of an embodiment of an HIV Savine. Also shown are the alignments of common HIV clade consensus sequences for the HIV env protein from the HIV Molecular Immunology Database 1997, Editors Bette Korber, John Moore, Cristian Brander, Richard Koup, Barton Haynes and Bruce Walker. Publisher, Los Alamos National Laboratory, Theoretical Biology and Biophysics, Los Alamos, N.Mex., Pub LAUR 98-485.

FIG. 11 is a diagrammatic representation showing overlapping segments of a parent polypeptide sequence for HIV nef [SEQ ID NO: 9] used for the construction of an embodiment of an HIV Savine. Also shown are the alignments of common HIV clade consensus sequences for the HIV nef protein from the HIV Molecular Immunology Database 1997, Editors Bette Korber, John Moore, Cristian Brander, Richard Koup, Barton Haynes and Bruce Walker. Publisher, Los Alamos National Laboratory, Theoretical Biology and Biophysics, Los Alamos, N.Mex., Pub LAUR 98-485.

FIG. 12 is a diagrammatic representation depicting the systematic segmentation of the designed degenerate consensus sequences for each HIV protein and the reverse translation of each segment into a DNA sequence. Also shown is the number of segments used during random rearrangement and amino acids that were removed. Amino acids surrounded by an open square were removed from the design, because degenerate codons to cater for the desired amino acid combination required too many degenerate bases to comply with the incorporation of degenerate sequence rules outlined in the description of the invention herein. Amino acids surrounded by an open circle were removed only in the segment concerned mainly because they were coded for in an oligonucleotide overlap region. Amino acids marked with an asterisk were designed differently in one fragment compared to the corresponding overlap region (see tat gene)

FIG. 13 is a diagrammatic representation showing the first and second most frequently used codons in mammals used to reverse translate HIV protein segments. Also shown are all first and second most frequently used degenerate codons for two amino acids where only one base is varied. Codons used where more than one base was varied were worked out in each case by comparing all the codons for each amino acid. The IUPAC codes for degenerate bases are also shown.

FIG. 14 illustrates the construction plan for the HIV Savine showing the approximate sizes of the subcassettes, cassettes and full-length Savine cDNA and the restriction sites involved in joining them together. Also shown are the extra sequences added onto each subcassette during their design and a brief description of how the subcassettes, cassettes and full length cDNA were constructed and transferred into appropriate DNA plasmids. Description of full length construction: pA was cleaved with XhoI/SalI and cloned into XhoI arms of the B cassette; pAB was cleaved with XhoI and cloned into XhoI arms of the C cassette; full length construct is excisable with either XbaI/BamHI at the 5' end or BglII at the 3' end. Options for excising cassettes: A) XbaI/BamHI at the 5' end, BglII/XhoI at the 3' end; B) XbaI/BamHI at the 5' end, BglII/SalI at the 3' end; C) XbaI/BamHI at the 5' end, BglII/SalI at the 3' end. Cleaving plasmid vectors: pDNAVacc is cleavable with XbaI/XhoI (DNA vaccination); pBCB07 or pTK7.5 vectors are cleavable with BamHI/SalI (Recombinant Vaccinia); pAvipox vector pAF09 is cleavable with BamHI/SalI (Recombinant Avipox).

FIG. 15 shows the full length DNA (17253 bp) and protein sequence (5742 aas) of the HIV Savine construct. Fragment boundaries are shown, together with the position of each fragment in each designed HIV protein, fragment number (in brackets), spacer residues (two alanine residues) and which fragment the spacer was for (open boxes and arrows). The location of residual restriction site joining sequences corresponding to subcassette or cassette boundaries (shaded boxes) are also shown, along with start and stop codons, Kozak sequence, the location of the murine influenza virus CTL epitope sequence (near the 3' end), important restriction sites at each end and the position of each degenerate amino acid (indicated by ‘X’).

FIG. 16 depicts the layout and position of oligonucleotides in the designed DNA sequence for subcassette A1. The sequences which anneal to the short amplification oligonucleotides are indicated by hatched boxes and the position of oligonucleotide overlap regions are dark shaded.

FIG. 17: Panel (a) depicts the stepwise asymmetric PCR of the two halves of subcassette A1 (lanes 2-5 and 7-9, respectively) and final splicing together by SOEing (lane 10). DNA standards in lane 1 are pUC18 digested with Sau3AI. Panel (b) shows the stepwise ligation-mediated joining and PCR amplification of each cassette as indicated. DNA standards in lane 1 are SPP1 cut with EcoRI.

FIG. 18: Panel (a) shows summary of the construction of the DNA vaccine plasmids that express one HIV Savine cassette. Panel (b) shows a summary of the construction of the plasmids used for marker rescue recombination to generate Vaccinia viruses expressing one HIV Savine cassette. Panel (c) shows a summary of the construction of the DNA vaccine plasmids which each express a version of the full-length HIV Savine cDNA FIG. 19 shows restimulation of HIV specific polyclonal CTL responses from three HIV-infected patients by the HIV Savine constructs. PBMCs from three different patients were restimulated for 7 days by infection with Vaccinia virus pools expressing the HIV Savine cassettes: Pool 1 included VV-AC1 and VV-BC1; Pool 2 included VV-AC2, VV-BC2 and VV-CC2. The restimulated PBMCs were then mixed with autologous LCLs (effector to target ratio of 50:1), which were either uninfected or infected with either Vaccinia viruses expressing the HIV proteins gag (VV-gag), env (VV-env) or pol (VV-pol), VV-HIV Savine pools 1 (light bars) or 2 (dark bars) or a control Vaccinia virus (VV-Lac) and the amount of $^{51}$Cr released used to determine percent specific lysis. K562 cells were used to determine the level of NK cell-mediated killing in their stimulated culture.

FIG. 25 shows an algorithm, which inter alia utilises the steps of the method shown in FIG. 24.

FIG. 26 shows an example of applying the algorithm of FIG. 25 to an input consensus polyprotein sequence of Hepatitis C1a to execute the segmentation of the polyprotein sequence, the rearrangement of the segments, the linkage of the rearranged segments and the outputting of synthetic polynucleotide and polypeptide sequences for the preparation of Savines for treating and/or preventing Hepatitis C infection.

FIG. 27 illustrates an example of applying the algorithm of FIG. 25 to input consensus melanocyte differentiation antigens (gp100, MART, TRP-1, Tyros, Trp-2, MC1R, MUC1F and MUC1R) and to consensus melanoma specific antigens (BAGE, GAGE-1, gp100In4, MAGE-1, MAGE-3, PRAME, TRP2IN2, NYNSO1a, NYNSO1b and LAGE1) to facilitate segmentation of those sequences, to rearrange the segments, to link the rearranged segments and to synthetic polynucleotide and polypeptide sequences for the preparation of Savines for treating and/or preventing melanoma.

FIG. 30 shows six HIV Savine cassette sequences (A1 [SEQ ID NO: 393], A2 [SEQ ID NO: 399], B1[SEQ ID NO: 395], B2 [SEQ ID NO: 401], C1 [SEQ ID NO: 397] and C2 [SEQ ID NO: 403]). A1, B1 and C1 can be joined together using, for example, convenient restriction enzyme sites provided at the ends of each cassette to construct an embodiment of a full length HIV Savine [SEQ ID NO: 405]. A2, B2 and C2 can also be joined together to provide another embodiment of a full length HIV Savine with 350 aa mutations common in major HIV clades. The cassettes A/B/C can be joined into single constructs using specific restriction enzyme sites incorporated after the start codon or before the stop codon in the cassettes

Figure 1:
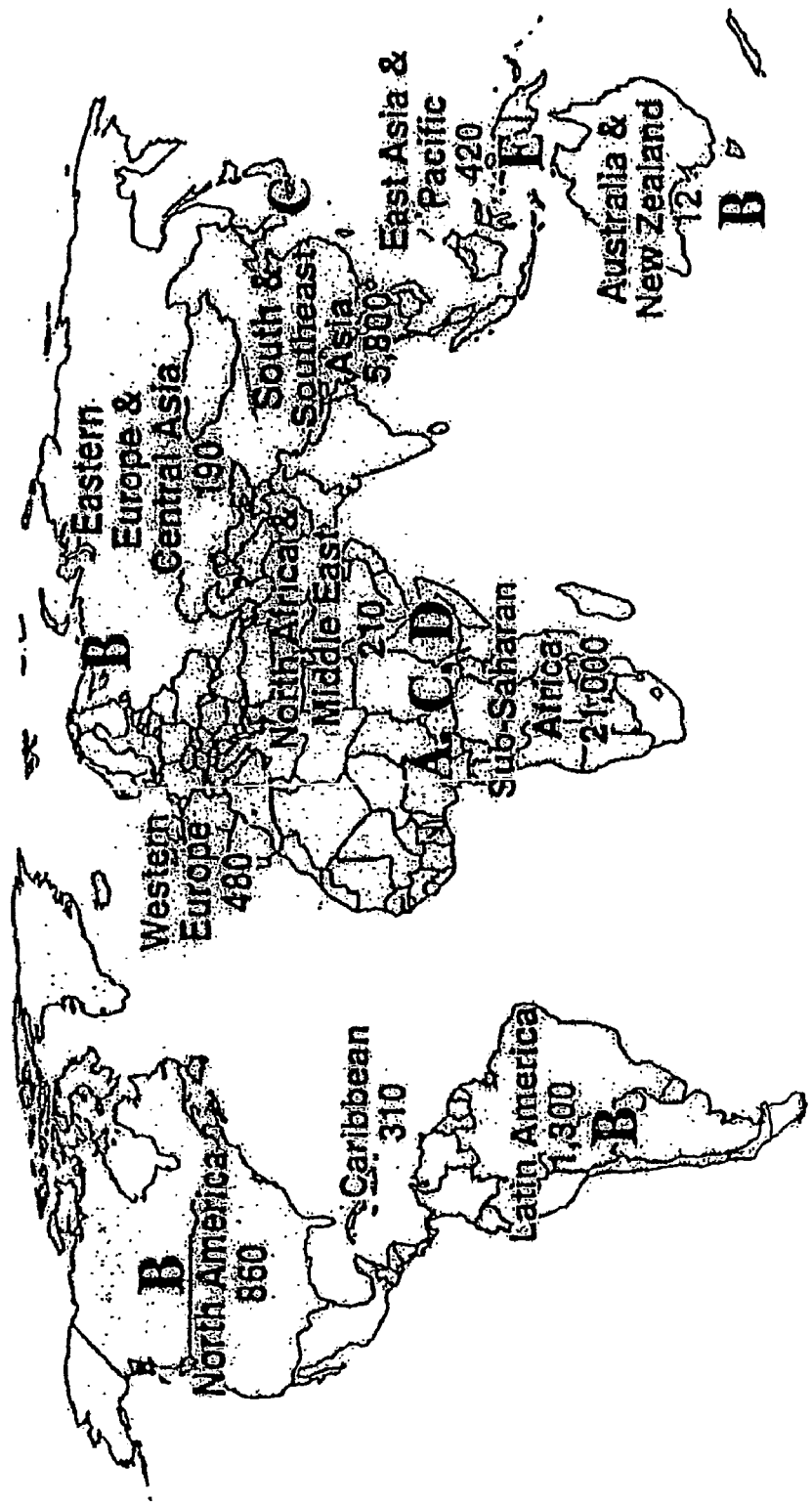
FIG. 1 is a diagrammatic representation showing the number of people living with AIDS in 1998 in various parts of the world and most prevalent HIV clades in these regions. Estimates generated by UNAIDS.
Figure 2:
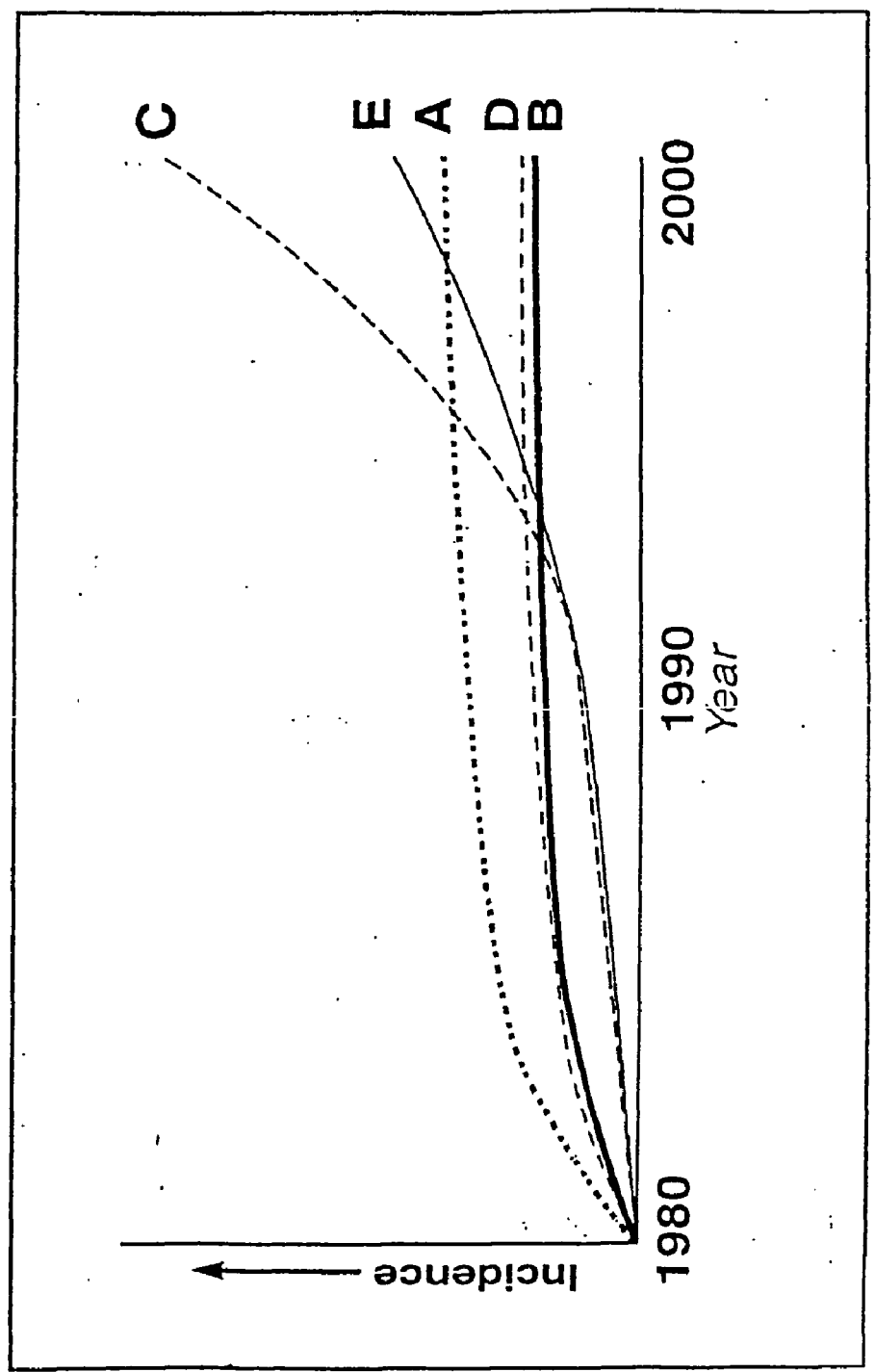
FIG. 2 is a graphical representation showing trends in the incidence of the common HIV clades and estimates for the future. Graph from the International Aids Vaccine Initiative (IAVI).

BRIEF DESCRIPTION OF THE SEQUENCES:
SUMMARY TABLE

TABLE A

| SEQUENCE ID NUMBER | SEQUENCE | Length |
|---|---|---|
| SEQ ID NO: 1 | GAG consensus polypeptide | 499 aa |
| SEQ ID NO: 2 | POL consensus polypeptide | 995 aa |
| SEQ ID NO: 3 | VIF consensus polypeptide | 192 aa |
| SEQ ID NO: 4 | VPR consensus polypeptide | 96 aa |
| SEQ ID NO: 5 | TAT consensus polypeptide | 102 aa |
| SEQ ID NO: 6 | REV consensus polypeptide | 123 aa |
| SEQ ID NO: 7 | VPU consensus polypeptide | 81 aa |
| SEQ ID NO: 8 | ENV consensus polypeptide | 651 aa |
| SEQ ID NO: 9 | NEF consensus polypeptide | 206 aa |
| SEQ ID NO: 10 | GAG segment 1 | 90 nts |
| SEQ ID NO: 11 | Polypeptide encoded by SEQ ID NO: 10 | 30 aa |
| SEQ ID NO: 12 | GAG segment 2 | 90 nts |
| SEQ ID NO: 13 | Polypeptide encoded by SEQ ID NO: 12 | 30 aa |
| SEQ ID NO: 14 | GAG segment 3 | 90 nts |

TABLE A-continued

| SEQUENCE ID NUMBER | SEQUENCE | Length | |
|---|---|---|---|
| SEQ ID NO: 15 | Polypeptide encoded by SEQ ID NO: 14 | 30 | aa |
| SEQ ID NO: 16 | GAG segment 4 | 90 | nts |
| SEQ ID NO: 17 | Polypeptide encoded by SEQ ID NO: 16 | 30 | aa |
| SEQ ID NO: 18 | GAG segment 5 | 90 | nts |
| SEQ ID NO: 19 | Polypeptide encoded by SEQ ID NO: 18 | 30 | aa |
| SEQ ID NO: 20 | GAG segment 6 | 90 | nts |
| SEQ ID NO: 21 | Polypeptide encoded by SEQ ID NO: 20 | 30 | aa |
| SEQ ID NO: 22 | GAG segment 7 | 90 | nts |
| SEQ ID NO: 23 | Polypeptide encoded by SEQ ID NO: 22 | 30 | aa |
| SEQ ID NO: 24 | GAG segment 8 | 90 | nts |
| SEQ ID NO: 25 | Polypeptide encoded by SEQ ID NO: 24 | 30 | aa |
| SEQ ID NO: 26 | GAG segment 9 | 90 | nts |
| SEQ ID NO: 27 | Polypeptide encoded by SEQ ID NO: 26 | 30 | aa |
| SEQ ID NO: 28 | GAG segment 10 | 90 | nts |
| SEQ ID NO: 29 | Polypeptide encoded by SEQ ID NO: 28 | 30 | aa |
| SEQ ID NO: 30 | GAG segment 11 | 90 | nts |
| SEQ ID NO: 31 | Polypeptide encoded by SEQ ID NO: 30 | 30 | aa |
| SEQ ID NO: 32 | GAG segment 12 | 90 | nts |
| SEQ ID NO: 33 | Polypeptide encoded by SEQ ID NO: 32 | 30 | aa |
| SEQ ID NO: 34 | GAG segment 13 | 90 | nts |
| SEQ ID NO: 35 | Polypeptide encoded by SEQ ID NO: 34 | 30 | aa |
| SEQ ID NO: 36 | GAG segment 14 | 90 | nts |
| SEQ ID NO: 37 | Polypeptide encoded by SEQ ID NO: 36 | 30 | aa |
| SEQ ID NO: 38 | GAG segment 15 | 90 | nts |
| SEQ ID NO: 39 | Polypeptide encoded by SEQ ID NO: 38 | 30 | aa |
| SEQ ID NO: 40 | GAG segment 16 | 90 | nts |
| SEQ ID NO: 41 | Polypeptide encoded by SEQ ID NO: 40 | 30 | aa |
| SEQ ID NO: 42 | GAG segment 17 | 90 | nts |
| SEQ ID NO: 43 | Polypeptide encoded by SEQ ID NO: 42 | 30 | aa |
| SEQ ID NO: 44 | GAG segment 18 | 90 | nts |
| SEQ ID NO: 45 | Polypeptide encoded by SEQ ID NO: 44 | 30 | aa |
| SEQ ID NO: 46 | GAG segment 19 | 90 | nts |
| SEQ ID NO: 47 | Polypeptide encoded by SEQ ID NO: 46 | 30 | aa |
| SEQ ID NO: 48 | GAG segment 20 | 90 | nts |
| SEQ ID NO: 49 | Polypeptide encoded by SEQ ID NO: 48 | 30 | aa |
| SEQ ID NO: 50 | GAG segment 21 | 90 | nts |
| SEQ ID NO: 51 | Polypeptide encoded by SEQ ID NO: 50 | 30 | aa |
| SEQ ID NO: 52 | GAG segment 22 | 90 | nts |
| SEQ ID NO: 53 | Polypeptide encoded by SEQ ID NO: 52 | 30 | aa |
| SEQ ID NO: 54 | GAG segment 23 | 90 | nts |
| SEQ ID NO: 55 | Polypeptide encoded by SEQ ID NO: 54 | 30 | aa |
| SEQ ID NO: 56 | GAG segment 24 | 90 | nts |
| SEQ ID NO: 57 | Polypeptide encoded by SEQ ID NO: 56 | 30 | aa |
| SEQ ID NO: 58 | GAG segment 25 | 90 | nts |
| SEQ ID NO: 59 | Polypeptide encoded by SEQ ID NO: 58 | 30 | aa |
| SEQ ID NO: 60 | GAG segment 26 | 90 | nts |
| SEQ ID NO: 61 | Polypeptide encoded by SEQ ID NO: 60 | 30 | aa |
| SEQ ID NO: 62 | GAG segment 27 | 90 | nts |
| SEQ ID NO: 63 | Polypeptide encoded by SEQ ID NO: 62 | 30 | aa |
| SEQ ID NO: 64 | GAG segment 28 | 90 | nts |
| SEQ ID NO: 65 | Polypeptide encoded by SEQ ID NO: 64 | 30 | aa |
| SEQ ID NO: 66 | GAG segment 29 | 90 | nts |
| SEQ ID NO: 67 | Polypeptide encoded by SEQ ID NO: 66 | 30 | aa |
| SEQ ID NO: 68 | GAG segment 30 | 90 | nts |
| SEQ ID NO: 69 | Polypeptide encoded by SEQ ID NO: 68 | 30 | aa |
| SEQ ID NO: 70 | GAG segment 31 | 90 | nts |
| SEQ ID NO: 71 | Polypeptide encoded by SEQ ID NO: 70 | 30 | aa |
| SEQ ID NO: 72 | GAG segment 32 | 90 | nts |
| SEQ ID NO: 73 | Polypeptide encoded by SEQ ID NO: 72 | 30 | aa |
| SEQ ID NO: 74 | GAG segment 33 | 57 | nts |
| SEQ ID NO: 75 | Polypeptide encoded by SEQ ID NO: 74 | 19 | aa |
| SEQ ID NO: 76 | POL segment 1 | 90 | nts |
| SEQ ID NO: 77 | Polypeptide encoded by SEQ ID NO: 76 | 30 | aa |
| SEQ ID NO: 78 | POL segment 2 | 90 | nts |
| SEQ ID NO: 79 | Polypeptide encoded by SEQ ID NO: 78 | 30 | aa |
| SEQ ID NO: 80 | POL segment 3 | 90 | nts |
| SEQ ID NO: 81 | Polypeptide encoded by SEQ ID NO: 80 | 30 | aa |
| SEQ ID NO: 82 | POL segment 4 | 90 | nts |
| SEQ ID NO: 83 | Polypeptide encoded by SEQ ID NO: 82 | 30 | aa |
| SEQ ID NO: 84 | POL segment 5 | 90 | nts |
| SEQ ID NO: 85 | Polypeptide encoded by SEQ ID NO: 84 | 30 | aa |
| SEQ ID NO: 86 | POL segment 6 | 90 | nts |
| SEQ ID NO: 87 | Polypeptide encoded by SEQ ID NO: 86 | 30 | aa |
| SEQ ID NO: 88 | POL segment 7 | 90 | nts |
| SEQ ID NO: 89 | Polypeptide encoded by SEQ ID NO: 88 | 30 | aa |
| SEQ ID NO: 90 | POL segment 8 | 90 | nts |

TABLE A-continued

| SEQUENCE ID NUMBER | SEQUENCE | Length | |
|---|---|---|---|
| SEQ ID NO: 91 | Polypeptide encoded by SEQ ID NO: 90 | 30 | aa |
| SEQ ID NO: 92 | POL segment 9 | 90 | nts |
| SEQ ID NO: 93 | Polypeptide encoded by SEQ ID NO: 92 | 30 | aa |
| SEQ ID NO: 94 | POL segment 10 | 90 | nts |
| SEQ ID NO: 95 | Polypeptide encoded by SEQ ID NO: 94 | 30 | aa |
| SEQ ID NO: 96 | POL segment 11 | 90 | nts |
| SEQ ID NO: 97 | Polypeptide encoded by SEQ ID NO: 96 | 30 | aa |
| SEQ ID NO: 98 | POL segment 12 | 90 | nts |
| SEQ ID NO: 99 | Polypeptide encoded by SEQ ID NO: 98 | 30 | aa |
| SEQ ID NO: 100 | POL segment 13 | 90 | nts |
| SEQ ID NO: 101 | Polypeptide encoded by SEQ ID NO: 100 | 30 | aa |
| SEQ ID NO: 102 | POL segment 14 | 90 | nts |
| SEQ ID NO: 103 | Polypeptide encoded by SEQ ID NO: 102 | 30 | aa |
| SEQ ID NO: 104 | POL segment 15 | 90 | nts |
| SEQ ID NO: 105 | Polypeptide encoded by SEQ ID NO: 104 | 30 | aa |
| SEQ ID NO: 106 | POL segment 16 | 90 | nts |
| SEQ ID NO: 107 | Polypeptide encoded by SEQ ID NO: 106 | 30 | aa |
| SEQ ID NO: 108 | POL segment 17 | 90 | nts |
| SEQ ID NO: 109 | Polypeptide encoded by SEQ ID NO: 108 | 30 | aa |
| SEQ ID NO: 110 | POL segment 18 | 90 | nts |
| SEQ ID NO: 111 | Polypeptide encoded by SEQ ID NO: 110 | 30 | aa |
| SEQ ID NO: 112 | POL segment 19 | 90 | nts |
| SEQ ID NO: 113 | Polypeptide encoded by SEQ ID NO: 112 | 30 | aa |
| SEQ ID NO: 114 | POL segment 20 | 90 | nts |
| SEQ ID NO: 115 | Polypeptide encoded by SEQ ID NO: 114 | 30 | aa |
| SEQ ID NO: 116 | POL segment 21 | 90 | nts |
| SEQ ID NO: 117 | Polypeptide encoded by SEQ ID NO: 116 | 30 | aa |
| SEQ ID NO: 118 | POL segment 22 | 90 | nts |
| SEQ ID NO: 119 | Polypeptide encoded by SEQ ID NO: 118 | 30 | aa |
| SEQ ID NO: 120 | POL segment 23 | 90 | nts |
| SEQ ID NO: 121 | Polypeptide encoded by SEQ ID NO: 120 | 30 | aa |
| SEQ ID NO: 122 | POL segment 24 | 90 | nts |
| SEQ ID NO: 123 | Polypeptide encoded by SEQ ID NO: 122 | 30 | aa |
| SEQ ID NO: 124 | POL segment 25 | 90 | nts |
| SEQ ID NO: 125 | Polypeptide encoded by SEQ ID NO: 124 | 30 | aa |
| SEQ ID NO: 126 | POL segment 26 | 90 | nts |
| SEQ ID NO: 127 | Polypeptide encoded by SEQ ID NO: 126 | 30 | aa |
| SEQ ID NO: 128 | POL segment 27 | 90 | nts |
| SEQ ID NO: 129 | Polypeptide encoded by SEQ ID NO: 128 | 30 | aa |
| SEQ ID NO: 130 | POL segment 28 | 90 | nts |
| SEQ ID NO: 131 | Polypeptide encoded by SEQ ID NO: 130 | 30 | aa |
| SEQ ID NO: 132 | POL segment 29 | 90 | nts |
| SEQ ID NO: 133 | Polypeptide encoded by SEQ ID NO: 132 | 30 | aa |
| SEQ ID NO: 134 | POL segment 30 | 90 | nts |
| SEQ ID NO: 135 | Polypeptide encoded by SEQ ID NO: 134 | 30 | aa |
| SEQ ID NO: 136 | POL segment 31 | 90 | nts |
| SEQ ID NO: 137 | Polypeptide encoded by SEQ ID NO: 136 | 30 | aa |
| SEQ ID NO: 138 | POL segment 32 | 90 | nts |
| SEQ ID NO: 139 | Polypeptide encoded by SEQ ID NO: 138 | 30 | aa |
| SEQ ID NO: 140 | POL segment 33 | 90 | nts |
| SEQ ID NO: 141 | Polypeptide encoded by SEQ ID NO: 140 | 30 | aa |
| SEQ ID NO: 142 | POL segment 34 | 90 | nts |
| SEQ ID NO: 143 | Polypeptide encoded by SEQ ID NO: 142 | 30 | aa |
| SEQ ID NO: 144 | POL segment 35 | 90 | nts |
| SEQ ID NO: 145 | Polypeptide encoded by SEQ ID NO: 144 | 30 | aa |
| SEQ ID NO: 146 | POL segment 36 | 90 | nts |
| SEQ ID NO: 147 | Polypeptide encoded by SEQ ID NO: 146 | 30 | aa |
| SEQ ID NO: 148 | POL segment 37 | 90 | nts |
| SEQ ID NO: 149 | Polypeptide encoded by SEQ ID NO: 148 | 30 | aa |
| SEQ ID NO: 150 | POL segment 38 | 90 | nts |
| SEQ ID NO: 151 | Polypeptide encoded by SEQ ID NO: 150 | 30 | aa |
| SEQ ID NO: 152 | POL segment 39 | 90 | nts |
| SEQ ID NO: 153 | Polypeptide encoded by SEQ ID NO: 152 | 30 | aa |
| SEQ ID NO: 154 | POL segment 40 | 90 | nts |
| SEQ ID NO: 155 | Polypeptide encoded by SEQ ID NO: 154 | 30 | aa |
| SEQ ID NO: 156 | POL segment 41 | 90 | nts |
| SEQ ID NO: 157 | Polypeptide encoded by SEQ ID NO: 156 | 30 | aa |
| SEQ ID NO: 158 | POL segment 42 | 90 | nts |
| SEQ ID NO: 159 | Polypeptide encoded by SEQ ID NO: 158 | 30 | aa |
| SEQ ID NO: 160 | POL segment 43 | 90 | nts |
| SEQ ID NO: 161 | Polypeptide encoded by SEQ ID NO: 160 | 30 | aa |
| SEQ ID NO: 162 | POL segment 44 | 90 | nts |
| SEQ ID NO: 163 | Polypeptide encoded by SEQ ID NO: 162 | 30 | aa |
| SEQ ID NO: 164 | POL segment 45 | 90 | nts |
| SEQ ID NO: 165 | Polypeptide encoded by SEQ ID NO: 164 | 30 | aa |
| SEQ ID NO: 166 | POL segment 46 | 90 | nts |

TABLE A-continued

| SEQUENCE ID NUMBER | SEQUENCE | Length | |
|---|---|---|---|
| SEQ ID NO: 167 | Polypeptide encoded by SEQ ID NO: 166 | 30 | aa |
| SEQ ID NO: 168 | POL segment 47 | 90 | nts |
| SEQ ID NO: 169 | Polypeptide encoded by SEQ ID NO: 168 | 30 | aa |
| SEQ ID NO: 170 | POL segment 48 | 90 | nts |
| SEQ ID NO: 171 | Polypeptide encoded by SEQ ID NO: 170 | 30 | aa |
| SEQ ID NO: 172 | POL segment 49 | 90 | nts |
| SEQ ID NO: 173 | Polypeptide encoded by SEQ ID NO: 172 | 30 | aa |
| SEQ ID NO: 174 | POL segment 50 | 90 | nts |
| SEQ ID NO: 175 | Polypeptide encoded by SEQ ID NO: 174 | 30 | aa |
| SEQ ID NO: 176 | POL segment 51 | 90 | nts |
| SEQ ID NO: 177 | Polypeptide encoded by SEQ ID NO: 176 | 30 | aa |
| SEQ ID NO: 178 | POL segment 52 | 90 | nts |
| SEQ ID NO: 179 | Polypeptide encoded by SEQ ID NO: 178 | 30 | aa |
| SEQ ID NO: 180 | POL segment 53 | 90 | nts |
| SEQ ID NO: 181 | Polypeptide encoded by SEQ ID NO: 180 | 30 | aa |
| SEQ ID NO: 182 | POL segment 54 | 90 | nts |
| SEQ ID NO: 183 | Polypeptide encoded by SEQ ID NO: 182 | 30 | aa |
| SEQ ID NO: 184 | POL segment 55 | 90 | nts |
| SEQ ID NO: 185 | Polypeptide encoded by SEQ ID NO: 184 | 30 | aa |
| SEQ ID NO: 186 | POL segment 56 | 90 | nts |
| SEQ ID NO: 187 | Polypeptide encoded by SEQ ID NO: 186 | 30 | aa |
| SEQ ID NO: 188 | POL segment 57 | 90 | nts |
| SEQ ID NO: 189 | Polypeptide encoded by SEQ ID NO: 188 | 30 | aa |
| SEQ ID NO: 190 | POL segment 58 | 90 | nts |
| SEQ ID NO: 191 | Polypeptide encoded by SEQ ID NO: 190 | 30 | aa |
| SEQ ID NO: 192 | POL segment 59 | 90 | nts |
| SEQ ID NO: 193 | Polypeptide encoded by SEQ ID NO: 192 | 30 | aa |
| SEQ ID NO: 194 | POL segment 60 | 90 | nts |
| SEQ ID NO: 195 | Polypeptide encoded by SEQ ID NO: 194 | 30 | aa |
| SEQ ID NO: 196 | POL segment 61 | 90 | nts |
| SEQ ID NO: 197 | Polypeptide encoded by SEQ ID NO: 196 | 30 | aa |
| SEQ ID NO: 198 | POL segment 62 | 90 | nts |
| SEQ ID NO: 199 | Polypeptide encoded by SEQ ID NO: 198 | 30 | aa |
| SEQ ID NO: 200 | POL segment 63 | 90 | nts |
| SEQ ID NO: 201 | Polypeptide encoded by SEQ ID NO: 200 | 30 | aa |
| SEQ ID NO: 202 | POL segment 64 | 90 | nts |
| SEQ ID NO: 203 | Polypeptide encoded by SEQ ID NO: 202 | 30 | aa |
| SEQ ID NO: 204 | POL segment 65 | 90 | nts |
| SEQ ID NO: 205 | Polypeptide encoded by SEQ ID NO: 204 | 30 | aa |
| SEQ ID NO: 206 | POL segment 66 | 60 | nts |
| SEQ ID NO: 207 | Polypeptide encoded by SEQ ID NO: 206 | 20 | aa |
| SEQ ID NO: 208 | VIF segment 1 | 90 | nts |
| SEQ ID NO: 209 | Polypeptide encoded by SEQ ID NO: 208 | 30 | aa |
| SEQ ID NO: 210 | VIF segment 2 | 90 | nts |
| SEQ ID NO: 211 | Polypeptide encoded by SEQ ID NO: 210 | 30 | aa |
| SEQ ID NO: 212 | VIF segment 3 | 90 | nts |
| SEQ ID NO: 213 | Polypeptide encoded by SEQ ID NO: 212 | 30 | aa |
| SEQ ID NO: 214 | VIF segment 4 | 90 | nts |
| SEQ ID NO: 215 | Polypeptide encoded by SEQ ID NO: 214 | 30 | aa |
| SEQ ID NO: 216 | VIF segment 5 | 90 | nts |
| SEQ ID NO: 217 | Polypeptide encoded by SEQ ID NO: 216 | 30 | aa |
| SEQ ID NO: 218 | VIF segment 6 | 90 | nts |
| SEQ ID NO: 219 | Polypeptide encoded by SEQ ID NO: 218 | 30 | aa |
| SEQ ID NO: 220 | VIF segment 7 | 90 | nts |
| SEQ ID NO: 221 | Polypeptide encoded by SEQ ID NO: 220 | 30 | aa |
| SEQ ID NO: 222 | VIF segment 8 | 90 | nts |
| SEQ ID NO: 223 | Polypeptide encoded by SEQ ID NO: 222 | 30 | aa |
| SEQ ID NO: 224 | VIF segment 9 | 90 | nts |
| SEQ ID NO: 225 | Polypeptide encoded by SEQ ID NO: 224 | 30 | aa |
| SEQ ID NO: 226 | VIF segment 10 | 90 | nts |
| SEQ ID NO: 227 | Polypeptide encoded by SEQ ID NO: 226 | 30 | aa |
| SEQ ID NO: 228 | VIF segment 11 | 90 | nts |
| SEQ ID NO: 229 | Polypeptide encoded by SEQ ID NO: 228 | 30 | aa |
| SEQ ID NO: 230 | VIF segment 12 | 81 | nts |
| SEQ ID NO: 231 | Polypeptide encoded by SEQ ID NO: 230 | 27 | aa |
| SEQ ID NO: 232 | VPR segment 1 | 90 | nts |
| SEQ ID NO: 233 | Polypeptide encoded by SEQ ID NO: 232 | 30 | aa |
| SEQ ID NO: 234 | VPR segment 2 | 90 | nts |
| SEQ ID NO: 235 | Polypeptide encoded by SEQ ID NO: 234 | 30 | aa |
| SEQ ID NO: 236 | VPR segment 3 | 90 | nts |
| SEQ ID NO: 237 | Polypeptide encoded by SEQ ID NO: 236 | 30 | aa |
| SEQ ID NO: 238 | VPR segment 4 | 90 | nts |
| SEQ ID NO: 239 | Polypeptide encoded by SEQ ID NO: 238 | 30 | aa |
| SEQ ID NO: 240 | VPR segment 5 | 90 | nts |
| SEQ ID NO: 241 | Polypeptide encoded by SEQ ID NO: 240 | 30 | aa |
| SEQ ID NO: 242 | VPR segment 6 | 63 | nts |

TABLE A-continued

| SEQUENCE ID NUMBER | SEQUENCE | Length | |
|---|---|---|---|
| SEQ ID NO: 243 | Polypeptide encoded by SEQ ID NO: 242 | 21 | aa |
| SEQ ID NO: 244 | TAT segment 1 | 90 | nts |
| SEQ ID NO: 245 | Polypeptide encoded by SEQ ID NO: 244 | 30 | aa |
| SEQ ID NO: 246 | TAT segment 2 | 90 | nts |
| SEQ ID NO: 247 | Polypeptide encoded by SEQ ID NO: 246 | 30 | aa |
| SEQ ID NO: 248 | TAT segment 3 | 90 | nts |
| SEQ ID NO: 249 | Polypeptide encoded by SEQ ID NO: 248 | 30 | aa |
| SEQ ID NO: 250 | TAT segment 4 | 90 | nts |
| SEQ ID NO: 251 | Polypeptide encoded by SEQ ID NO: 250 | 30 | aa |
| SEQ ID NO: 252 | TAT segment 5 | 90 | nts |
| SEQ ID NO: 253 | Polypeptide encoded by SEQ ID NO: 252 | 30 | aa |
| SEQ ID NO: 254 | TAT segment 6 | 81 | nts |
| SEQ ID NO: 255 | Polypeptide encoded by SEQ ID NO: 254 | 27 | aa |
| SEQ ID NO: 256 | REV segment 1 | 90 | nts |
| SEQ ID NO: 257 | Polypeptide encoded by SEQ ID NO: 256 | 30 | aa |
| SEQ ID NO: 258 | REV segment 2 | 90 | nts |
| SEQ ID NO: 259 | Polypeptide encoded by SEQ ID NO: 258 | 30 | aa |
| SEQ ID NO: 260 | REV segment 3 | 90 | nts |
| SEQ ID NO: 261 | Polypeptide encoded by SEQ ID NO: 260 | 30 | aa |
| SEQ ID NO: 262 | REV segment 4 | 90 | nts |
| SEQ ID NO: 263 | Polypeptide encoded by SEQ ID NO: 262 | 30 | aa |
| SEQ ID NO: 264 | REV segment 5 | 90 | nts |
| SEQ ID NO: 265 | Polypeptide encoded by SEQ ID NO: 264 | 30 | aa |
| SEQ ID NO: 266 | REV segment 6 | 90 | nts |
| SEQ ID NO: 267 | Polypeptide encoded by SEQ ID NO: 266 | 30 | aa |
| SEQ ID NO: 268 | REV segment 7 | 90 | nts |
| SEQ ID NO: 269 | Polypeptide encoded by SEQ ID NO: 268 | 30 | aa |
| SEQ ID NO: 270 | REV segment 8 | 54 | nts |
| SEQ ID NO: 271 | Polypeptide encoded by SEQ ID NO: 270 | 18 | aa |
| SEQ ID NO: 272 | VPU segment 1 | 90 | nts |
| SEQ ID NO: 273 | Polypeptide encoded by SEQ ID NO: 272 | 30 | aa |
| SEQ ID NO: 274 | VPU segment 2 | 90 | nts |
| SEQ ID NO: 275 | Polypeptide encoded by SEQ ID NO: 274 | 30 | aa |
| SEQ ID NO: 276 | VPU segment 3 | 90 | nts |
| SEQ ID NO: 277 | Polypeptide encoded by SEQ ID NO: 276 | 30 | aa |
| SEQ ID NO: 278 | VPU segment 4 | 90 | nts |
| SEQ ID NO: 279 | Polypeptide encoded by SEQ ID NO: 278 | 30 | aa |
| SEQ ID NO: 280 | VPU segment 5 | 63 | nts |
| SEQ ID NO: 281 | Polypeptide encoded by SEQ ID NO: 280 | 21 | aa |
| SEQ ID NO: 282 | ENV segment 1 | 90 | nts |
| SEQ ID NO: 283 | Polypeptide encoded by SEQ ID NO: 282 | 30 | aa |
| SEQ ID NO: 284 | ENV segment 2 | 90 | nts |
| SEQ ID NO: 285 | Polypeptide encoded by SEQ ID NO: 284 | 30 | aa |
| SEQ ID NO: 286 | ENV segment 3 | 90 | nts |
| SEQ ID NO: 287 | Polypeptide encoded by SEQ ID NO: 286 | 30 | aa |
| SEQ ID NO: 288 | ENV segment 4 | 90 | nts |
| SEQ ID NO: 289 | Polypeptide encoded by SEQ ID NO: 288 | 30 | aa |
| SEQ ID NO: 290 | ENV segment 5 | 90 | nts |
| SEQ ID NO: 291 | Polypeptide encoded by SEQ ID NO: 290 | 30 | aa |
| SEQ ID NO: 292 | ENV segment 6 | 90 | nts |
| SEQ ID NO: 293 | Polypeptide encoded by SEQ ID NO: 292 | 30 | aa |
| SEQ ID NO: 294 | ENV segment 7 | 90 | nts |
| SEQ ID NO: 295 | Polypeptide encoded by SEQ ID NO: 294 | 30 | aa |
| SEQ ID NO: 296 | ENV segment 8 | 90 | nts |
| SEQ ID NO: 297 | Polypeptide encoded by SEQ ID NO: 296 | 30 | aa |
| SEQ ID NO: 298 | ENV segment 9 | 57 | nts |
| SEQ ID NO: 299 | Polypeptide encoded by SEQ ID NO: 298 | 19 | aa |
| SEQ ID NO: 300 | GAP A segment 1 | 90 | nts |
| SEQ ID NO: 301 | Polypeptide encoded by SEQ ID NO: 300 | 30 | aa |
| SEQ ID NO: 302 | GAP A segment 2 | 90 | nts |
| SEQ ID NO: 303 | Polypeptide encoded by SEQ ID NO: 302 | 30 | aa |
| SEQ ID NO: 304 | GAP A segment 3 | 90 | nts |
| SEQ ID NO: 305 | Polypeptide encoded by SEQ ID NO: 304 | 30 | aa |
| SEQ ID NO: 306 | GAP A segment 4 | 90 | nts |
| SEQ ID NO: 307 | Polypeptide encoded by SEQ ID NO: 306 | 30 | aa |
| SEQ ID NO: 308 | GAP A segment 5 | 90 | nts |
| SEQ ID NO: 309 | Polypeptide encoded by SEQ ID NO: 308 | 30 | aa |
| SEQ ID NO: 310 | GAP A segment 6 | 90 | nts |
| SEQ ID NO: 311 | Polypeptide encoded by SEQ ID NO: 310 | 30 | aa |
| SEQ ID NO: 312 | GAP A segment 7 | 75 | nts |
| SEQ ID NO: 313 | Polypeptide encoded by SEQ ID NO: 312 | 25 | nts |
| SEQ ID NO: 314 | GAP B segment 1 | 90 | nts |
| SEQ ID NO: 315 | Polypeptide encoded by SEQ ID NO: 314 | 30 | aa |
| SEQ ID NO: 316 | GAP B segment 2 | 90 | nts |
| SEQ ID NO: 317 | Polypeptide encoded by SEQ ID NO: 316 | 30 | aa |
| SEQ ID NO: 318 | GAP B segment 3 | 90 | nts |

TABLE A-continued

| SEQUENCE ID NUMBER | SEQUENCE | Length | |
|---|---|---|---|
| SEQ ID NO: 319 | Polypeptide encoded by SEQ ID NO: 318 | 30 | aa |
| SEQ ID NO: 320 | GAP B segment 4 | 90 | nts |
| SEQ ID NO: 321 | Polypeptide encoded by SEQ ID NO: 320 | 30 | aa |
| SEQ ID NO: 322 | GAP B segment 5 | 90 | nts |
| SEQ ID NO: 323 | Polypeptide encoded by SEQ ID NO: 322 | 30 | aa |
| SEQ ID NO: 324 | GAP B segment 6 | 90 | nts |
| SEQ ID NO: 325 | Polypeptide encoded by SEQ ID NO: 324 | 30 | aa |
| SEQ ID NO: 326 | GAP B segment 7 | 90 | nts |
| SEQ ID NO: 327 | Polypeptide encoded by SEQ ID NO: 326 | 30 | aa |
| SEQ ID NO: 328 | GAP B segment 8 | 90 | nts |
| SEQ ID NO: 329 | Polypeptide encoded by SEQ ID NO: 328 | 30 | aa |
| SEQ ID NO: 330 | GAP B segment 9 | 90 | nts |
| SEQ ID NO: 331 | Polypeptide encoded by SEQ ID NO: 330 | 30 | aa |
| SEQ ID NO: 332 | GAP B segment 10 | 90 | nts |
| SEQ ID NO: 333 | Polypeptide encoded by SEQ ID NO: 332 | 30 | aa |
| SEQ ID NO: 334 | GAP B segment 11 | 90 | nts |
| SEQ ID NO: 335 | Polypeptide encoded by SEQ ID NO: 334 | 30 | aa |
| SEQ ID NO: 336 | GAP B segment 12 | 90 | nts |
| SEQ ID NO: 337 | Polypeptide encoded by SEQ ID NO: 336 | 30 | aa |
| SEQ ID NO: 338 | GAP B segment 13 | 90 | nts |
| SEQ ID NO: 339 | Polypeptide encoded by SEQ ID NO: 338 | 30 | aa |
| SEQ ID NO: 340 | GAP B segment 14 | 90 | nts |
| SEQ ID NO: 341 | Polypeptide encoded by SEQ ID NO: 340 | 30 | aa |
| SEQ ID NO: 342 | GAP B segment 15 | 90 | nts |
| SEQ ID NO: 343 | Polypeptide encoded by SEQ ID NO: 342 | 30 | aa |
| SEQ ID NO: 344 | GAP B segment 16 | 90 | nts |
| SEQ ID NO: 345 | Polypeptide encoded by SEQ ID NO: 344 | 30 | aa |
| SEQ ID NO: 346 | GAP B segment 17 | 90 | nts |
| SEQ ID NO: 347 | Polypeptide encoded by SEQ ID NO: 346 | 30 | aa |
| SEQ ID NO: 348 | GAP B segment 18 | 90 | nts |
| SEQ ID NO: 349 | Polypeptide encoded by SEQ ID NO: 348 | 30 | aa |
| SEQ ID NO: 350 | GAP B segment 19 | 90 | nts |
| SEQ ID NO: 351 | Polypeptide encoded by SEQ ID NO: 350 | 30 | aa |
| SEQ ID NO: 352 | GAP B segment 20 | 90 | nts |
| SEQ ID NO: 353 | Polypeptide encoded by SEQ ID NO: 352 | 30 | aa |
| SEQ ID NO: 354 | GAP B segment 21 | 90 | nts |
| SEQ ID NO: 355 | Polypeptide encoded by SEQ ID NO: 354 | 30 | aa |
| SEQ ID NO: 356 | GAP B segment 22 | 90 | nts |
| SEQ ID NO: 357 | Polypeptide encoded by SEQ ID NO: 356 | 30 | aa |
| SEQ ID NO: 358 | GAP B segment 23 | 90 | nts |
| SEQ ID NO: 359 | Polypeptide encoded by SEQ ID NO: 358 | 30 | aa |
| SEQ ID NO: 360 | GAP B segment 24 | 90 | nts |
| SEQ ID NO: 361 | Polypeptide encoded by SEQ ID NO: 360 | 30 | aa |
| SEQ ID NO: 362 | GAP B segment 25 | 90 | nts |
| SEQ ID NO: 363 | Polypeptide encoded by SEQ ID NO: 362 | 30 | aa |
| SEQ ID NO: 364 | GAP B segment 26 | 66 | nts |
| SEQ ID NO: 365 | Polypeptide encoded by SEQ ID NO: 364 | 22 | aa |
| SEQ ID NO: 366 | NEF segment 1 | 90 | nts |
| SEQ ID NO: 367 | Polypeptide encoded by SEQ ID NO: 366 | 30 | aa |
| SEQ ID NO: 368 | NEF segment 2 | 90 | nts |
| SEQ ID NO: 369 | Polypeptide encoded by SEQ ID NO: 368 | 30 | aa |
| SEQ ID NO: 370 | NEF segment 3 | 90 | nts |
| SEQ ID NO: 371 | Polypeptide encoded by SEQ ID NO: 370 | 30 | aa |
| SEQ ID NO: 372 | NEF segment 4 | 90 | nts |
| SEQ ID NO: 373 | Polypeptide encoded by SEQ ID NO: 372 | 30 | aa |
| SEQ ID NO: 374 | NEF segment 5 | 90 | nts |
| SEQ ID NO: 375 | Polypeptide encoded by SEQ ID NO: 374 | 30 | aa |
| SEQ ID NO: 376 | NEF segment 6 | 90 | nts |
| SEQ ID NO: 377 | Polypeptide encoded by SEQ ID NO: 376 | 30 | aa |
| SEQ ID NO: 378 | NEF segment 7 | 90 | nts |
| SEQ ID NO: 379 | Polypeptide encoded by SEQ ID NO: 378 | 30 | aa |
| SEQ ID NO: 380 | NEF segment 8 | 90 | nts |
| SEQ ID NO: 381 | Polypeptide encoded by SEQ ID NO: 380 | 30 | aa |
| SEQ ID NO: 382 | NEF segment 9 | 90 | nts |
| SEQ ID NO: 383 | Polypeptide encoded by SEQ ID NO: 382 | 30 | aa |
| SEQ ID NO: 384 | NEF segment 10 | 90 | nts |
| SEQ ID NO: 385 | Polypeptide encoded by SEQ ID NO: 384 | 30 | aa |
| SEQ ID NO: 386 | NEF segment 11 | 90 | nts |
| SEQ ID NO: 387 | Polypeptide encoded by SEQ ID NO: 386 | 30 | aa |
| SEQ ID NO: 388 | NEF segment 12 | 90 | nts |
| SEQ ID NO: 389 | Polypeptide encoded by SEQ ID NO: 388 | 30 | aa |
| SEQ ID NO: 390 | NEF segment 13 | 78 | nts |
| SEQ ID NO: 391 | Polypeptide encoded by SEQ ID NO: 390 | 26 | aa |
| SEQ ID NO: 392 | HIV Cassette A1 | 5703 | nts |
| SEQ ID NO: 393 | Polypeptide encoded by SEQ ID NO: 392 | 1896 | aa |
| SEQ ID NO: 394 | HIV Cassette B1 | 5685 | nts |

TABLE A-continued

| SEQUENCE ID NUMBER | SEQUENCE | Length | |
|---|---|---|---|
| SEQ ID NO: 395 | Polypeptide encoded by SEQ ID NO: 394 | 1890 | aa |
| SEQ ID NO: 396 | HIV Cassette C1 | 5925 | nts |
| SEQ ID NO: 397 | Polypeptide encoded by SEQ ID NO: 396 | 1967 | aa |
| SEQ ID NO: 398 | HIV Cassette A2 | 5703 | nts |
| SEQ ID NO: 399 | Polypeptide encoded by SEQ ID NO: 398 | 1896 | aa |
| SEQ ID NO: 400 | HIV Cassette B2 | 5685 | nts |
| SEQ ID NO: 401 | Polypeptide encoded by SEQ ID NO: 400 | 1890 | aa |
| SEQ ID NO: 402 | HIV Cassette C2 | 5925 | nts |
| SEQ ID NO: 403 | Polypeptide encoded by SEQ ID NO: 402 | 1967 | aa |
| SEQ ID NO: 404 | HIV complete Savine | 17244 | nts |
| SEQ ID NO: 405 | Polypeptide encoded by SEQ ID NO: 404 | 5747 | aa |
| SEQ ID NO: 406 | HepC1a consensus polyprotein sequence | 3011 | aa |
| SEQ ID NO: 407 | HepC1a segment 1 | 90 | nts |
| SEQ ID NO: 408 | Polypeptide encoded by SEQ ID NO: 407 | 30 | aa |
| SEQ ID NO: 409 | HepC1a segment 2 | 90 | nts |
| SEQ ID NO: 410 | Polypeptide encoded by SEQ ID NO: 409 | 30 | aa |
| SEQ ID NO: 411 | HepC1a segment 3 | 90 | nts |
| SEQ ID NO: 412 | Polypeptide encoded by SEQ ID NO: 411 | 30 | aa |
| SEQ ID NO: 413 | HepC1a segment 4 | 90 | nts |
| SEQ ID NO: 414 | Polypeptide encoded by SEQ ID NO: 413 | 30 | aa |
| SEQ ID NO: 415 | HepC1a segment 5 | 90 | nts |
| SEQ ID NO: 416 | Polypeptide encoded by SEQ ID NO: 415 | 30 | aa |
| SEQ ID NO: 417 | HepC1a segment 6 | 90 | nts |
| SEQ ID NO: 418 | Polypeptide encoded by SEQ ID NO: 417 | 30 | aa |
| SEQ ID NO: 419 | HepC1a segment 7 | 90 | nts |
| SEQ ID NO: 420 | Polypeptide encoded by SEQ ID NO: 419 | 30 | aa |
| SEQ ID NO: 421 | HepC1a segment 8 | 90 | nts |
| SEQ ID NO: 422 | Polypeptide encoded by SEQ ID NO: 421 | 30 | aa |
| SEQ ID NO: 423 | HepC1a segment 9 | 90 | nts |
| SEQ ID NO: 424 | Polypeptide encoded by SEQ ID NO: 423 | 30 | aa |
| SEQ ID NO: 425 | HepC1a segment 10 | 90 | nts |
| SEQ ID NO: 426 | Polypeptide encoded by SEQ ID NO: 425 | 30 | aa |
| SEQ ID NO: 427 | HepC1a segment 11 | 90 | nts |
| SEQ ID NO: 428 | Polypeptide encoded by SEQ ID NO: 427 | 30 | aa |
| SEQ ID NO: 429 | HepC1a segment 12 | 90 | nts |
| SEQ ID NO: 430 | Polypeptide encoded by SEQ ID NO: 429 | 30 | aa |
| SEQ ID NO: 431 | HepC1a segment 13 | 90 | nts |
| SEQ ID NO: 432 | Polypeptide encoded by SEQ ID NO: 431 | 30 | aa |
| SEQ ID NO: 433 | HepC1a segment 14 | 90 | nts |
| SEQ ID NO: 434 | Polypeptide encoded by SEQ ID NO: 433 | 30 | aa |
| SEQ ID NO: 435 | HepC1a segment 15 | 90 | nts |
| SEQ ID NO: 436 | Polypeptide encoded by SEQ ID NO: 435 | 30 | aa |
| SEQ ID NO: 437 | HepC1a segment 16 | 90 | nts |
| SEQ ID NO: 438 | Polypeptide encoded by SEQ ID NO: 437 | 30 | aa |
| SEQ ID NO: 439 | HepC1a segment 17 | 90 | nts |
| SEQ ID NO: 440 | Polypeptide encoded by SEQ ID NO: 439 | 30 | aa |
| SEQ ID NO: 441 | HepC1a segment 18 | 90 | nts |
| SEQ ID NO: 442 | Polypeptide encoded by SEQ ID NO: 441 | 30 | aa |
| SEQ ID NO: 443 | HepC1a segment 19 | 90 | nts |
| SEQ ID NO: 444 | Polypeptide encoded by SEQ ID NO: 443 | 30 | aa |
| SEQ ID NO: 445 | HepC1a segment 20 | 90 | nts |
| SEQ ID NO: 446 | Polypeptide encoded by SEQ ID NO: 445 | 30 | aa |
| SEQ ID NO: 447 | HepC1a segment 21 | 90 | nts |
| SEQ ID NO: 448 | Polypeptide encoded by SEQ ID NO: 447 | 30 | aa |
| SEQ ID NO: 449 | HepC1a segment 22 | 90 | nts |
| SEQ ID NO: 450 | Polypeptide encoded by SEQ ID NO: 449 | 30 | aa |
| SEQ ID NO: 451 | HepC1a segment 23 | 90 | nts |
| SEQ ID NO: 452 | Polypeptide encoded by SEQ ID NO: 451 | 30 | aa |
| SEQ ID NO: 453 | HepC1a segment 24 | 90 | nts |
| SEQ ID NO: 454 | Polypeptide encoded by SEQ ID NO: 453 | 30 | aa |
| SEQ ID NO: 455 | HepC1a segment 25 | 90 | nts |
| SEQ ID NO: 456 | Polypeptide encoded by SEQ ID NO: 455 | 30 | aa |
| SEQ ID NO: 457 | HepC1a segment 26 | 90 | nts |
| SEQ ID NO: 458 | Polypeptide encoded by SEQ ID NO: 457 | 30 | aa |
| SEQ ID NO: 459 | HepC1a segment 27 | 90 | nts |
| SEQ ID NO: 460 | Polypeptide encoded by SEQ ID NO: 459 | 30 | aa |
| SEQ ID NO: 461 | HepC1a segment 28 | 90 | nts |
| SEQ ID NO: 462 | Polypeptide encoded by SEQ ID NO: 461 | 30 | aa |
| SEQ ID NO: 463 | HepC1a segment 29 | 90 | nts |
| SEQ ID NO: 464 | Polypeptide encoded by SEQ ID NO: 463 | 30 | aa |
| SEQ ID NO: 465 | HepC1a segment 30 | 90 | nts |
| SEQ ID NO: 466 | Polypeptide encoded by SEQ ID NO: 465 | 30 | aa |
| SEQ ID NO: 467 | HepC1a segment 31 | 90 | nts |
| SEQ ID NO: 468 | Polypeptide encoded by SEQ ID NO: 467 | 30 | aa |
| SEQ ID NO: 469 | HepC1a segment 32 | 90 | nts |
| SEQ ID NO: 470 | Polypeptide encoded by SEQ ID NO: 469 | 30 | aa |

TABLE A-continued

| SEQUENCE ID NUMBER | SEQUENCE | Length | |
|---|---|---|---|
| SEQ ID NO: 471 | HepC1a segment 33 | 90 | nts |
| SEQ ID NO: 472 | Polypeptide encoded by SEQ ID NO: 471 | 30 | aa |
| SEQ ID NO: 473 | HepC1a segment 34 | 90 | nts |
| SEQ ID NO: 474 | Polypeptide encoded by SEQ ID NO: 473 | 30 | aa |
| SEQ ID NO: 475 | HepC1a segment 35 | 90 | nts |
| SEQ ID NO: 476 | Polypeptide encoded by SEQ ID NO: 475 | 30 | aa |
| SEQ ID NO: 477 | HepC1a segment 36 | 90 | nts |
| SEQ ID NO: 478 | Polypeptide encoded by SEQ ID NO: 477 | 30 | aa |
| SEQ ID NO: 479 | HepC1a segment 37 | 90 | nts |
| SEQ ID NO: 480 | Polypeptide encoded by SEQ ID NO: 479 | 30 | aa |
| SEQ ID NO: 481 | HepC1a segment 38 | 90 | nts |
| SEQ ID NO: 482 | Polypeptide encoded by SEQ ID NO: 481 | 30 | aa |
| SEQ ID NO: 483 | HepC1a segment 39 | 90 | nts |
| SEQ ID NO: 484 | Polypeptide encoded by SEQ ID NO: 483 | 30 | aa |
| SEQ ID NO: 485 | HepC1a segment 40 | 90 | nts |
| SEQ ID NO: 486 | Polypeptide encoded by SEQ ID NO: 485 | 30 | aa |
| SEQ ID NO: 487 | HepC1a segment 41 | 90 | nts |
| SEQ ID NO: 488 | Polypeptide encoded by SEQ ID NO: 487 | 30 | aa |
| SEQ ID NO: 489 | HepC1a segment 42 | 90 | nts |
| SEQ ID NO: 490 | Polypeptide encoded by SEQ ID NO: 489 | 30 | aa |
| SEQ ID NO: 491 | HepC1a segment 43 | 90 | nts |
| SEQ ID NO: 492 | Polypeptide encoded by SEQ ID NO: 491 | 30 | aa |
| SEQ ID NO: 493 | HepC1a segment 44 | 90 | nts |
| SEQ ID NO: 494 | Polypeptide encoded by SEQ ID NO: 493 | 30 | aa |
| SEQ ID NO: 495 | HepC1a segment 45 | 90 | nts |
| SEQ ID NO: 496 | Polypeptide encoded by SEQ ID NO: 495 | 30 | aa |
| SEQ ID NO: 497 | HepC1a segment 46 | 90 | nts |
| SEQ ID NO: 498 | Polypeptide encoded by SEQ ID NO: 497 | 30 | aa |
| SEQ ID NO: 499 | HepC1a segment 47 | 90 | nts |
| SEQ ID NO: 500 | Polypeptide encoded by SEQ ID NO: 499 | 30 | aa |
| SEQ ID NO: 501 | HepC1a segment 48 | 90 | nts |
| SEQ ID NO: 502 | Polypeptide encoded by SEQ ID NO: 501 | 30 | aa |
| SEQ ID NO: 503 | HepC1a segment 49 | 90 | nts |
| SEQ ID NO: 504 | Polypeptide encoded by SEQ ID NO: 503 | 30 | aa |
| SEQ ID NO: 505 | HepC1a segment 50 | 90 | nts |
| SEQ ID NO: 506 | Polypeptide encoded by SEQ ID NO: 505 | 30 | aa |
| SEQ ID NO: 507 | HepC1a segment 51 | 90 | nts |
| SEQ ID NO: 508 | Polypeptide encoded by SEQ ID NO: 507 | 30 | aa |
| SEQ ID NO: 509 | HepC1a segment 52 | 90 | nts |
| SEQ ID NO: 510 | Polypeptide encoded by SEQ ID NO: 509 | 30 | aa |
| SEQ ID NO: 511 | HepC1a segment 53 | 90 | nts |
| SEQ ID NO: 512 | Polypeptide encoded by SEQ ID NO: 511 | 30 | aa |
| SEQ ID NO: 513 | HepC1a segment 54 | 90 | nts |
| SEQ ID NO: 514 | Polypeptide encoded by SEQ ID NO: 513 | 30 | aa |
| SEQ ID NO: 515 | HepC1a segment 55 | 90 | nts |
| SEQ ID NO: 516 | Polypeptide encoded by SEQ ID NO: 515 | 30 | aa |
| SEQ ID NO: 517 | HepC1a segment 56 | 90 | nts |
| SEQ ID NO: 518 | Polypeptide encoded by SEQ ID NO: 517 | 30 | aa |
| SEQ ID NO: 519 | HepC1a segment 57 | 90 | nts |
| SEQ ID NO: 520 | Polypeptide encoded by SEQ ID NO: 519 | 30 | aa |
| SEQ ID NO: 521 | HepC1a segment 58 | 90 | nts |
| SEQ ID NO: 522 | Polypeptide encoded by SEQ ID NO: 521 | 30 | aa |
| SEQ ID NO: 523 | HepC1a segment 59 | 90 | nts |
| SEQ ID NO: 524 | Polypeptide encoded by SEQ ID NO: 523 | 30 | aa |
| SEQ ID NO: 525 | HepC1a segment 60 | 90 | nts |
| SEQ ID NO: 526 | Polypeptide encoded by SEQ ID NO: 525 | 30 | aa |
| SEQ ID NO: 527 | HepC1a segment 61 | 90 | nts |
| SEQ ID NO: 528 | Polypeptide encoded by SEQ ID NO: 527 | 30 | aa |
| SEQ ID NO: 529 | HepC1a segment 62 | 90 | nts |
| SEQ ID NO: 530 | Polypeptide encoded by SEQ ID NO: 529 | 30 | aa |
| SEQ ID NO: 531 | HepC1a segment 63 | 90 | nts |
| SEQ ID NO: 532 | Polypeptide encoded by SEQ ID NO: 531 | 30 | aa |
| SEQ ID NO: 533 | HepC1a segment 64 | 90 | nts |
| SEQ ID NO: 534 | Polypeptide encoded by SEQ ID NO: 533 | 30 | aa |
| SEQ ID NO: 535 | HepC1a segment 65 | 90 | nts |
| SEQ ID NO: 536 | Polypeptide encoded by SEQ ID NO: 535 | 30 | aa |
| SEQ ID NO: 537 | HepC1a segment 66 | 90 | nts |
| SEQ ID NO: 538 | Polypeptide encoded by SEQ ID NO: 537 | 30 | aa |
| SEQ ID NO: 539 | HepC1a segment 67 | 90 | nts |
| SEQ ID NO: 540 | Polypeptide encoded by SEQ ID NO: 539 | 30 | aa |
| SEQ ID NO: 541 | HepC1a segment 68 | 90 | nts |
| SEQ ID NO: 542 | Polypeptide encoded by SEQ ID NO: 541 | 30 | aa |
| SEQ ID NO: 543 | HepC1a segment 69 | 90 | nts |
| SEQ ID NO: 544 | Polypeptide encoded by SEQ ID NO: 543 | 30 | aa |
| SEQ ID NO: 545 | HepC1a segment 70 | 90 | nts |
| SEQ ID NO: 546 | Polypeptide encoded by SEQ ID NO: 545 | 30 | aa |

TABLE A-continued

| SEQUENCE ID NUMBER | SEQUENCE | Length |
|---|---|---|
| SEQ ID NO: 547 | HepC1a segment 71 | 90 nts |
| SEQ ID NO: 548 | Polypeptide encoded by SEQ ID NO: 547 | 30 aa |
| SEQ ID NO: 549 | HepC1a segment 72 | 90 nts |
| SEQ ID NO: 550 | Polypeptide encoded by SEQ ID NO: 549 | 30 aa |
| SEQ ID NO: 551 | HepC1a segment 73 | 90 nts |
| SEQ ID NO: 552 | Polypeptide encoded by SEQ ID NO: 551 | 30 aa |
| SEQ ID NO: 553 | HepC1a segment 74 | 90 nts |
| SEQ ID NO: 554 | Polypeptide encoded by SEQ ID NO: 553 | 30 aa |
| SEQ ID NO: 555 | HepC1a segment 75 | 90 nts |
| SEQ ID NO: 556 | Polypeptide encoded by SEQ ID NO: 555 | 30 aa |
| SEQ ID NO: 557 | HepC1a segment 76 | 90 nts |
| SEQ ID NO: 558 | Polypeptide encoded by SEQ ID NO: 557 | 30 aa |
| SEQ ID NO: 559 | HepC1a segment 77 | 90 nts |
| SEQ ID NO: 560 | Polypeptide encoded by SEQ ID NO: 559 | 30 aa |
| SEQ ID NO: 561 | HepC1a segment 78 | 90 nts |
| SEQ ID NO: 562 | Polypeptide encoded by SEQ ID NO: 561 | 30 aa |
| SEQ ID NO: 563 | HepC1a segment 79 | 90 nts |
| SEQ ID NO: 564 | Polypeptide encoded by SEQ ID NO: 563 | 30 aa |
| SEQ ID NO: 565 | HepC1a segment 80 | 90 nts |
| SEQ ID NO: 566 | Polypeptide encoded by SEQ ID NO: 565 | 30 aa |
| SEQ ID NO: 567 | HepC1a segment 81 | 90 nts |
| SEQ ID NO: 568 | Polypeptide encoded by SEQ ID NO: 567 | 30 aa |
| SEQ ID NO: 569 | HepC1a segment 82 | 90 nts |
| SEQ ID NO: 570 | Polypeptide encoded by SEQ ID NO: 569 | 30 aa |
| SEQ ID NO: 571 | HepC1a segment 83 | 90 nts |
| SEQ ID NO: 572 | Polypeptide encoded by SEQ ID NO: 571 | 30 aa |
| SEQ ID NO: 573 | HepC1a segment 84 | 90 nts |
| SEQ ID NO: 574 | Polypeptide encoded by SEQ ID NO: 573 | 30 aa |
| SEQ ID NO: 575 | HepC1a segment 85 | 90 nts |
| SEQ ID NO: 576 | Polypeptide encoded by SEQ ID NO: 575 | 30 aa |
| SEQ ID NO: 577 | HepC1a segment 86 | 90 nts |
| SEQ ID NO: 578 | Polypeptide encoded by SEQ ID NO: 577 | 30 aa |
| SEQ ID NO: 579 | HepC1a segment 87 | 90 nts |
| SEQ ID NO: 580 | Polypeptide encoded by SEQ ID NO: 579 | 30 aa |
| SEQ ID NO: 581 | HepC1a segment 88 | 90 nts |
| SEQ ID NO: 582 | Polypeptide encoded by SEQ ID NO: 581 | 30 aa |
| SEQ ID NO: 583 | HepC1a segment 89 | 90 nts |
| SEQ ID NO: 584 | Polypeptide encoded by SEQ ID NO: 583 | 30 aa |
| SEQ ID NO: 585 | HepC1a segment 90 | 90 nts |
| SEQ ID NO: 586 | Polypeptide encoded by SEQ ID NO: 585 | 30 aa |
| SEQ ID NO: 587 | HepC1a segment 91 | 90 nts |
| SEQ ID NO: 588 | Polypeptide encoded by SEQ ID NO: 587 | 30 aa |
| SEQ ID NO: 589 | HepC1a segment 92 | 90 nts |
| SEQ ID NO: 590 | Polypeptide encoded by SEQ ID NO: 589 | 30 aa |
| SEQ ID NO: 591 | HepC1a segment 93 | 90 nts |
| SEQ ID NO: 592 | Polypeptide encoded by SEQ ID NO: 591 | 30 aa |
| SEQ ID NO: 593 | HepC1a segment 94 | 90 nts |
| SEQ ID NO: 594 | Polypeptide encoded by SEQ ID NO: 593 | 30 aa |
| SEQ ID NO: 595 | HepC1a segment 95 | 90 nts |
| SEQ ID NO: 596 | Polypeptide encoded by SEQ ID NO: 595 | 30 aa |
| SEQ ID NO: 597 | HepC1a segment 96 | 90 nts |
| SEQ ID NO: 598 | Polypeptide encoded by SEQ ID NO: 597 | 30 aa |
| SEQ ID NO: 599 | HepC1a segment 97 | 90 nts |
| SEQ ID NO: 600 | Polypeptide encoded by SEQ ID NO: 599 | 30 aa |
| SEQ ID NO: 601 | HepC1a segment 98 | 90 nts |
| SEQ ID NO: 602 | Polypeptide encoded by SEQ ID NO: 601 | 30 aa |
| SEQ ID NO: 603 | HepC1a segment 99 | 90 nts |
| SEQ ID NO: 604 | Polypeptide encoded by SEQ ID NO: 603 | 30 aa |
| SEQ ID NO: 605 | HepC1a segment 100 | 90 nts |
| SEQ ID NO: 606 | Polypeptide encoded by SEQ ID NO: 605 | 30 aa |
| SEQ ID NO: 607 | HepC1a segment 101 | 90 nts |
| SEQ ID NO: 608 | Polypeptide encoded by SEQ ID NO: 607 | 30 aa |
| SEQ ID NO: 609 | HepC1a segment 102 | 90 nts |
| SEQ ID NO: 610 | Polypeptide encoded by SEQ ID NO: 609 | 30 aa |
| SEQ ID NO: 611 | HepC1a segment 103 | 90 nts |
| SEQ ID NO: 612 | Polypeptide encoded by SEQ ID NO: 611 | 30 aa |
| SEQ ID NO: 613 | HepC1a segment 104 | 90 nts |
| SEQ ID NO: 614 | Polypeptide encoded by SEQ ID NO: 613 | 30 aa |
| SEQ ID NO: 615 | HepC1a segment 105 | 90 nts |
| SEQ ID NO: 616 | Polypeptide encoded by SEQ ID NO: 615 | 30 aa |
| SEQ ID NO: 617 | HepC1a segment 106 | 90 nts |
| SEQ ID NO: 618 | Polypeptide encoded by SEQ ID NO: 617 | 30 aa |
| SEQ ID NO: 619 | HepC1a segment 107 | 90 nts |
| SEQ ID NO: 620 | Polypeptide encoded by SEQ ID NO: 619 | 30 aa |
| SEQ ID NO: 621 | HepC1a segment 108 | 90 nts |
| SEQ ID NO: 622 | Polypeptide encoded by SEQ ID NO: 621 | 30 aa |

TABLE A-continued

| SEQUENCE ID NUMBER | SEQUENCE | Length | |
|---|---|---|---|
| SEQ ID NO: 623 | HepC1a segment 109 | 90 | nts |
| SEQ ID NO: 624 | Polypeptide encoded by SEQ ID NO: 623 | 30 | aa |
| SEQ ID NO: 625 | HepC1a segment 110 | 90 | nts |
| SEQ ID NO: 626 | Polypeptide encoded by SEQ ID NO: 625 | 30 | aa |
| SEQ ID NO: 627 | HepC1a segment 111 | 90 | nts |
| SEQ ID NO: 628 | Polypeptide encoded by SEQ ID NO: 627 | 30 | aa |
| SEQ ID NO: 629 | HepC1a segment 112 | 90 | nts |
| SEQ ID NO: 630 | Polypeptide encoded by SEQ ID NO: 629 | 30 | aa |
| SEQ ID NO: 631 | HepC1a segment 113 | 90 | nts |
| SEQ ID NO: 632 | Polypeptide encoded by SEQ ID NO: 631 | 30 | aa |
| SEQ ID NO: 633 | HepC1a segment 114 | 90 | nts |
| SEQ ID NO: 634 | Polypeptide encoded by SEQ ID NO: 633 | 30 | aa |
| SEQ ID NO: 635 | HepC1a segment 115 | 90 | nts |
| SEQ ID NO: 636 | Polypeptide encoded by SEQ ID NO: 635 | 30 | aa |
| SEQ ID NO: 637 | HepC1a segment 116 | 90 | nts |
| SEQ ID NO: 638 | Polypeptide encoded by SEQ ID NO: 637 | 30 | aa |
| SEQ ID NO: 639 | HepC1a segment 117 | 90 | nts |
| SEQ ID NO: 640 | Polypeptide encoded by SEQ ID NO: 639 | 30 | aa |
| SEQ ID NO: 641 | HepC1a segment 118 | 90 | nts |
| SEQ ID NO: 642 | Polypeptide encoded by SEQ ID NO: 641 | 30 | aa |
| SEQ ID NO: 643 | HepC1a segment 119 | 90 | nts |
| SEQ ID NO: 644 | Polypeptide encoded by SEQ ID NO: 643 | 30 | aa |
| SEQ ID NO: 645 | HepC1a segment 120 | 90 | nts |
| SEQ ID NO: 646 | Polypeptide encoded by SEQ ID NO: 645 | 30 | aa |
| SEQ ID NO: 647 | HepC1a segment 121 | 90 | nts |
| SEQ ID NO: 648 | Polypeptide encoded by SEQ ID NO: 647 | 30 | aa |
| SEQ ID NO: 649 | HepC1a segment 122 | 90 | nts |
| SEQ ID NO: 650 | Polypeptide encoded by SEQ ID NO: 649 | 30 | aa |
| SEQ ID NO: 651 | HepC1a segment 123 | 90 | nts |
| SEQ ID NO: 652 | Polypeptide encoded by SEQ ID NO: 651 | 30 | aa |
| SEQ ID NO: 653 | HepC1a segment 124 | 90 | nts |
| SEQ ID NO: 654 | Polypeptide encoded by SEQ ID NO: 653 | 30 | aa |
| SEQ ID NO: 655 | HepC1a segment 125 | 90 | nts |
| SEQ ID NO: 656 | Polypeptide encoded by SEQ ID NO: 655 | 30 | aa |
| SEQ ID NO: 657 | HepC1a segment 126 | 90 | nts |
| SEQ ID NO: 658 | Polypeptide encoded by SEQ ID NO: 657 | 30 | aa |
| SEQ ID NO: 659 | HepC1a segment 127 | 90 | nts |
| SEQ ID NO: 660 | Polypeptide encoded by SEQ ID NO: 659 | 30 | aa |
| SEQ ID NO: 661 | HepC1a segment 128 | 90 | nts |
| SEQ ID NO: 662 | Polypeptide encoded by SEQ ID NO: 661 | 30 | aa |
| SEQ ID NO: 663 | HepC1a segment 129 | 90 | nts |
| SEQ ID NO: 664 | Polypeptide encoded by SEQ ID NO: 663 | 30 | aa |
| SEQ ID NO: 665 | HepC1a segment 130 | 90 | nts |
| SEQ ID NO: 666 | Polypeptide encoded by SEQ ID NO: 665 | 30 | aa |
| SEQ ID NO: 667 | HepC1a segment 131 | 90 | nts |
| SEQ ID NO: 668 | Polypeptide encoded by SEQ ID NO: 667 | 30 | aa |
| SEQ ID NO: 669 | HepC1a segment 132 | 90 | nts |
| SEQ ID NO: 670 | Polypeptide encoded by SEQ ID NO: 669 | 30 | aa |
| SEQ ID NO: 671 | HepC1a segment 133 | 90 | nts |
| SEQ ID NO: 672 | Polypeptide encoded by SEQ ID NO: 671 | 30 | aa |
| SEQ ID NO: 673 | HepC1a segment 134 | 90 | nts |
| SEQ ID NO: 674 | Polypeptide encoded by SEQ ID NO: 673 | 30 | aa |
| SEQ ID NO: 675 | HepC1a segment 135 | 90 | nts |
| SEQ ID NO: 676 | Polypeptide encoded by SEQ ID NO: 675 | 30 | aa |
| SEQ ID NO: 677 | HepC1a segment 136 | 90 | nts |
| SEQ ID NO: 678 | Polypeptide encoded by SEQ ID NO: 677 | 30 | aa |
| SEQ ID NO: 679 | HepC1a segment 137 | 90 | nts |
| SEQ ID NO: 680 | Polypeptide encoded by SEQ ID NO: 679 | 30 | aa |
| SEQ ID NO: 681 | HepC1a segment 138 | 90 | nts |
| SEQ ID NO: 682 | Polypeptide encoded by SEQ ID NO: 681 | 30 | aa |
| SEQ ID NO: 683 | HepC1a segment 139 | 90 | nts |
| SEQ ID NO: 684 | Polypeptide encoded by SEQ ID NO: 683 | 30 | aa |
| SEQ ID NO: 685 | HepC1a segment 140 | 90 | nts |
| SEQ ID NO: 686 | Polypeptide encoded by SEQ ID NO: 685 | 30 | aa |
| SEQ ID NO: 687 | HepC1a segment 141 | 90 | nts |
| SEQ ID NO: 688 | Polypeptide encoded by SEQ ID NO: 687 | 30 | aa |
| SEQ ID NO: 689 | HepC1a segment 142 | 90 | nts |
| SEQ ID NO: 690 | Polypeptide encoded by SEQ ID NO: 689 | 30 | aa |
| SEQ ID NO: 691 | HepC1a segment 143 | 90 | nts |
| SEQ ID NO: 692 | Polypeptide encoded by SEQ ID NO: 691 | 30 | aa |
| SEQ ID NO: 693 | HepC1a segment 144 | 90 | nts |
| SEQ ID NO: 694 | Polypeptide encoded by SEQ ID NO: 693 | 30 | aa |
| SEQ ID NO: 695 | HepC1a segment 145 | 90 | nts |
| SEQ ID NO: 696 | Polypeptide encoded by SEQ ID NO: 695 | 30 | aa |
| SEQ ID NO: 697 | HepC1a segment 146 | 90 | nts |
| SEQ ID NO: 698 | Polypeptide encoded by SEQ ID NO: 697 | 30 | aa |

TABLE A-continued

| SEQUENCE ID NUMBER | SEQUENCE | Length | |
|---|---|---|---|
| SEQ ID NO: 699 | HepC1a segment 147 | 90 | nts |
| SEQ ID NO: 700 | Polypeptide encoded by SEQ ID NO: 699 | 30 | aa |
| SEQ ID NO: 701 | HepC1a segment 148 | 90 | nts |
| SEQ ID NO: 702 | Polypeptide encoded by SEQ ID NO: 701 | 30 | aa |
| SEQ ID NO: 703 | HepC1a segment 149 | 90 | nts |
| SEQ ID NO: 704 | Polypeptide encoded by SEQ ID NO: 703 | 30 | aa |
| SEQ ID NO: 705 | HepC1a segment 150 | 90 | nts |
| SEQ ID NO: 706 | Polypeptide encoded by SEQ ID NO: 705 | 30 | aa |
| SEQ ID NO: 707 | HepC1a segment 151 | 90 | nts |
| SEQ ID NO: 708 | Polypeptide encoded by SEQ ID NO: 707 | 30 | aa |
| SEQ ID NO: 709 | HepC1a segment 152 | 90 | nts |
| SEQ ID NO: 710 | Polypeptide encoded by SEQ ID NO: 709 | 30 | aa |
| SEQ ID NO: 711 | HepC1a segment 153 | 90 | nts |
| SEQ ID NO: 712 | Polypeptide encoded by SEQ ID NO: 711 | 30 | aa |
| SEQ ID NO: 713 | HepC1a segment 154 | 90 | nts |
| SEQ ID NO: 714 | Polypeptide encoded by SEQ ID NO: 713 | 30 | aa |
| SEQ ID NO: 715 | HepC1a segment 155 | 90 | nts |
| SEQ ID NO: 716 | Polypeptide encoded by SEQ ID NO: 715 | 30 | aa |
| SEQ ID NO: 717 | HepC1a segment 156 | 90 | nts |
| SEQ ID NO: 718 | Polypeptide encoded by SEQ ID NO: 717 | 30 | aa |
| SEQ ID NO: 719 | HepC1a segment 157 | 90 | nts |
| SEQ ID NO: 720 | Polypeptide encoded by SEQ ID NO: 719 | 30 | aa |
| SEQ ID NO: 721 | HepC1a segment 158 | 90 | nts |
| SEQ ID NO: 722 | Polypeptide encoded by SEQ ID NO: 721 | 30 | aa |
| SEQ ID NO: 723 | HepC1a segment 159 | 90 | nts |
| SEQ ID NO: 724 | Polypeptide encoded by SEQ ID NO: 723 | 30 | aa |
| SEQ ID NO: 725 | HepC1a segment 160 | 90 | nts |
| SEQ ID NO: 726 | Polypeptide encoded by SEQ ID NO: 725 | 30 | aa |
| SEQ ID NO: 727 | HepC1a segment 161 | 90 | nts |
| SEQ ID NO: 728 | Polypeptide encoded by SEQ ID NO: 727 | 30 | aa |
| SEQ ID NO: 729 | HepC1a segment 162 | 90 | nts |
| SEQ ID NO: 730 | Polypeptide encoded by SEQ ID NO: 729 | 30 | aa |
| SEQ ID NO: 731 | HepC1a segment 163 | 90 | nts |
| SEQ ID NO: 732 | Polypeptide encoded by SEQ ID NO: 731 | 30 | aa |
| SEQ ID NO: 733 | HepC1a segment 164 | 90 | nts |
| SEQ ID NO: 734 | Polypeptide encoded by SEQ ID NO: 733 | 30 | aa |
| SEQ ID NO: 735 | HepC1a segment 165 | 90 | nts |
| SEQ ID NO: 736 | Polypeptide encoded by SEQ ID NO: 735 | 30 | aa |
| SEQ ID NO: 737 | HepC1a segment 166 | 90 | nts |
| SEQ ID NO: 738 | Polypeptide encoded by SEQ ID NO: 737 | 30 | aa |
| SEQ ID NO: 739 | HepC1a segment 167 | 90 | nts |
| SEQ ID NO: 740 | Polypeptide encoded by SEQ ID NO: 739 | 30 | aa |
| SEQ ID NO: 741 | HepC1a segment 168 | 90 | nts |
| SEQ ID NO: 742 | Polypeptide encoded by SEQ ID NO: 741 | 30 | aa |
| SEQ ID NO: 743 | HepC1a segment 169 | 90 | nts |
| SEQ ID NO: 744 | Polypeptide encoded by SEQ ID NO: 743 | 30 | aa |
| SEQ ID NO: 745 | HepC1a segment 170 | 90 | nts |
| SEQ ID NO: 746 | Polypeptide encoded by SEQ ID NO: 745 | 30 | aa |
| SEQ ID NO: 747 | HepC1a segment 171 | 90 | nts |
| SEQ ID NO: 748 | Polypeptide encoded by SEQ ID NO: 747 | 30 | aa |
| SEQ ID NO: 749 | HepC1a segment 172 | 90 | nts |
| SEQ ID NO: 750 | Polypeptide encoded by SEQ ID NO: 749 | 30 | aa |
| SEQ ID NO: 751 | HepC1a segment 173 | 90 | nts |
| SEQ ID NO: 752 | Polypeptide encoded by SEQ ID NO: 751 | 30 | aa |
| SEQ ID NO: 753 | HepC1a segment 174 | 90 | nts |
| SEQ ID NO: 754 | Polypeptide encoded by SEQ ID NO: 753 | 30 | aa |
| SEQ ID NO: 755 | HepC1a segment 175 | 90 | nts |
| SEQ ID NO: 756 | Polypeptide encoded by SEQ ID NO: 755 | 30 | aa |
| SEQ ID NO: 757 | HepC1a segment 176 | 90 | nts |
| SEQ ID NO: 758 | Polypeptide encoded by SEQ ID NO: 757 | 30 | aa |
| SEQ ID NO: 759 | HepC1a segment 177 | 90 | nts |
| SEQ ID NO: 760 | Polypeptide encoded by SEQ ID NO: 759 | 30 | aa |
| SEQ ID NO: 761 | HepC1a segment 178 | 90 | nts |
| SEQ ID NO: 762 | Polypeptide encoded by SEQ ID NO: 761 | 30 | aa |
| SEQ ID NO: 763 | HepC1a segment 179 | 90 | nts |
| SEQ ID NO: 764 | Polypeptide encoded by SEQ ID NO: 763 | 30 | aa |
| SEQ ID NO: 765 | HepC1a segment 180 | 90 | nts |
| SEQ ID NO: 766 | Polypeptide encoded by SEQ ID NO: 765 | 30 | aa |
| SEQ ID NO: 767 | HepC1a segment 181 | 90 | nts |
| SEQ ID NO: 768 | Polypeptide encoded by SEQ ID NO: 767 | 30 | aa |
| SEQ ID NO: 769 | HepC1a segment 182 | 90 | nts |
| SEQ ID NO: 770 | Polypeptide encoded by SEQ ID NO: 769 | 30 | aa |
| SEQ ID NO: 771 | HepC1a segment 183 | 90 | nts |
| SEQ ID NO: 772 | Polypeptide encoded by SEQ ID NO: 771 | 30 | aa |
| SEQ ID NO: 773 | HepC1a segment 184 | 90 | nts |
| SEQ ID NO: 774 | Polypeptide encoded by SEQ ID NO: 773 | 30 | aa |

TABLE A-continued

| SEQUENCE ID NUMBER | SEQUENCE | Length | |
|---|---|---|---|
| SEQ ID NO: 775 | HepC1a segment 185 | 90 | nts |
| SEQ ID NO: 776 | Polypeptide encoded by SEQ ID NO: 775 | 30 | aa |
| SEQ ID NO: 777 | HepC1a segment 186 | 90 | nts |
| SEQ ID NO: 778 | Polypeptide encoded by SEQ ID NO: 777 | 30 | aa |
| SEQ ID NO: 779 | HepC1a segment 187 | 90 | nts |
| SEQ ID NO: 780 | Polypeptide encoded by SEQ ID NO: 779 | 30 | aa |
| SEQ ID NO: 781 | HepC1a segment 188 | 90 | nts |
| SEQ ID NO: 782 | Polypeptide encoded by SEQ ID NO: 781 | 30 | aa |
| SEQ ID NO: 783 | HepC1a segment 189 | 90 | nts |
| SEQ ID NO: 784 | Polypeptide encoded by SEQ ID NO: 783 | 30 | aa |
| SEQ ID NO: 785 | HepC1a segment 190 | 90 | nts |
| SEQ ID NO: 786 | Polypeptide encoded by SEQ ID NO: 785 | 30 | aa |
| SEQ ID NO: 787 | HepC1a segment 191 | 90 | nts |
| SEQ ID NO: 788 | Polypeptide encoded by SEQ ID NO: 787 | 30 | aa |
| SEQ ID NO: 789 | HepC1a segment 192 | 90 | nts |
| SEQ ID NO: 790 | Polypeptide encoded by SEQ ID NO: 789 | 30 | aa |
| SEQ ID NO: 791 | HepC1a segment 193 | 90 | nts |
| SEQ ID NO: 792 | Polypeptide encoded by SEQ ID NO: 791 | 30 | aa |
| SEQ ID NO: 793 | HepC1a segment 194 | 90 | nts |
| SEQ ID NO: 794 | Polypeptide encoded by SEQ ID NO: 793 | 30 | aa |
| SEQ ID NO: 795 | HepC1a segment 195 | 90 | nts |
| SEQ ID NO: 796 | Polypeptide encoded by SEQ ID NO: 795 | 30 | aa |
| SEQ ID NO: 797 | HepC1a segment 196 | 90 | nts |
| SEQ ID NO: 798 | Polypeptide encoded by SEQ ID NO: 797 | 30 | aa |
| SEQ ID NO: 799 | HepC1a segment 197 | 90 | nts |
| SEQ ID NO: 800 | Polypeptide encoded by SEQ ID NO: 799 | 30 | aa |
| SEQ ID NO: 801 | HepC1a segment 198 | 90 | nts |
| SEQ ID NO: 802 | Polypeptide encoded by SEQ ID NO: 801 | 30 | aa |
| SEQ ID NO: 803 | HepC1a segment 199 | 90 | nts |
| SEQ ID NO: 804 | Polypeptide encoded by SEQ ID NO: 803 | 30 | aa |
| SEQ ID NO: 805 | HepC1a segment 200 | 90 | nts |
| SEQ ID NO: 806 | Polypeptide encoded by SEQ ID NO: 805 | 30 | aa |
| SEQ ID NO: 807 | HepC1a segment 201 | 45 | nts |
| SEQ ID NO: 808 | Polypeptide encoded by SEQ ID NO: 807 | 15 | aa |
| SEQ ID NO: 809 | HepC1a scrambled | 17955 | nts |
| SEQ ID NO: 810 | Polypeptide encoded by SEQ ID NO: 809 | 5985 | aa |
| SEQ ID NO: 811 | HepC Cassette A | 6065 | nts |
| SEQ ID NO: 812 | Polypeptide encoded by SEQ ID NO: 811 | 2011 | aa |
| SEQ ID NO: 813 | HepC Cassette B | 6069 | nts |
| SEQ ID NO: 814 | Polypeptide encoded by SEQ ID NO: 813 | 2010 | aa |
| SEQ ID NO: 815 | HepC Cassette C | 6030 | nts |
| SEQ ID NO: 816 | Polypeptide encoded by SEQ ID NO: 815 | 1997 | aa |
| SEQ ID NO: 817 | gp100 consensus polypeptide | 661 | aa |
| SEQ ID NO: 818 | MART consensus polypeptide | 118 | aa |
| SEQ ID NO: 819 | TRP-1 consensus polypeptide | 248 | aa |
| SEQ ID NO: 820 | Tyros consensus polypeptide | 529 | aa |
| SEQ ID NO: 821 | TRP2 consensus polypeptide | 519 | aa |
| SEQ ID NO: 822 | MC1R consensus polypeptide | 317 | aa |
| SEQ ID NO: 823 | MUC1F consensus polypeptide | 125 | aa |
| SEQ ID NO: 824 | MUC1R consensus polypeptide | 312 | aa |
| SEQ ID NO: 825 | BAGE consensus polypeptide | 43 | aa |
| SEQ ID NO: 826 | GAGE-1 consensus polypeptide | 138 | aa |
| SEQ ID NO: 827 | gp100ln4 consensus polypeptide | 51 | aa |
| SEQ ID NO: 828 | MAGE-1 consensus polypeptide | 309 | aa |
| SEQ ID NO: 829 | MAGE-3 consensus polypeptide | 314 | aa |
| SEQ ID NO: 830 | PRAME consensus polypeptide | 509 | aa |
| SEQ ID NO: 831 | TRP21N2 consensus polypeptide | 54 | aa |
| SEQ ID NO: 832 | NYNSO1a consensus polypeptide | 180 | aa |
| SEQ ID NO: 833 | NYNSO1b consensus polypeptide | 58 | aa |
| SEQ ID NO: 834 | LAGE1 consensus polypeptide | 180 | aa |
| SEQ ID NO: 835 | gp100 segment 1 | 90 | nts |
| SEQ ID NO: 836 | Polypeptide encoded by SEQ ID NO: 835 | 30 | aa |
| SEQ ID NO: 837 | gp100 segment 2 | 90 | nts |
| SEQ ID NO: 838 | Polypeptide encoded by SEQ ID NO: 837 | 30 | aa |
| SEQ ID NO: 839 | gp100 segment 3 | 90 | nts |
| SEQ ID NO: 840 | Polypeptide encoded by SEQ ID NO: 839 | 30 | aa |
| SEQ ID NO: 841 | gp100 segment 4 | 90 | nts |
| SEQ ID NO: 842 | Polypeptide encoded by SEQ ID NO: 841 | 30 | aa |
| SEQ ID NO: 843 | gp100 segment 5 | 90 | nts |
| SEQ ID NO: 844 | Polypeptide encoded by SEQ ID NO: 843 | 30 | aa |
| SEQ ID NO: 845 | gp100 segment 6 | 90 | nts |
| SEQ ID NO: 846 | Polypeptide encoded by SEQ ID NO: 845 | 30 | aa |
| SEQ ID NO: 847 | gp100 segment 7 | 90 | nts |
| SEQ ID NO: 848 | Polypeptide encoded by SEQ ID NO: 847 | 30 | aa |
| SEQ ID NO: 849 | gp100 segment 8 | 90 | nts |
| SEQ ID NO: 850 | Polypeptide encoded by SEQ ID NO: 849 | 30 | aa |

TABLE A-continued

| SEQUENCE ID NUMBER | SEQUENCE | Length | |
|---|---|---|---|
| SEQ ID NO: 851 | gp100 segment 9 | 90 | nts |
| SEQ ID NO: 852 | Polypeptide encoded by SEQ ID NO: 851 | 30 | aa |
| SEQ ID NO: 853 | gp100 segment 10 | 90 | nts |
| SEQ ID NO: 854 | Polypeptide encoded by SEQ ID NO: 853 | 30 | aa |
| SEQ ID NO: 855 | gp100 segment 11 | 90 | nts |
| SEQ ID NO: 856 | Polypeptide encoded by SEQ ID NO: 855 | 30 | aa |
| SEQ ID NO: 857 | gp100 segment 12 | 90 | nts |
| SEQ ID NO: 858 | Polypeptide encoded by SEQ ID NO: 857 | 30 | aa |
| SEQ ID NO: 859 | gp100 segment 13 | 90 | nts |
| SEQ ID NO: 860 | Polypeptide encoded by SEQ ID NO: 859 | 30 | aa |
| SEQ ID NO: 861 | gp100 segment 14 | 90 | nts |
| SEQ ID NO: 862 | Polypeptide encoded by SEQ ID NO: 861 | 30 | aa |
| SEQ ID NO: 863 | gp100 segment 15 | 90 | nts |
| SEQ ID NO: 864 | Polypeptide encoded by SEQ ID NO: 863 | 30 | aa |
| SEQ ID NO: 865 | gp100 segment 16 | 90 | nts |
| SEQ ID NO: 866 | Polypeptide encoded by SEQ ID NO: 865 | 30 | aa |
| SEQ ID NO: 867 | gp100 segment 17 | 90 | nts |
| SEQ ID NO: 868 | Polypeptide encoded by SEQ ID NO: 867 | 30 | aa |
| SEQ ID NO: 869 | gp100 segment 18 | 90 | nts |
| SEQ ID NO: 870 | Polypeptide encoded by SEQ ID NO: 869 | 30 | aa |
| SEQ ID NO: 871 | gp100 segment 19 | 90 | nts |
| SEQ ID NO: 872 | Polypeptide encoded by SEQ ID NO: 871 | 30 | aa |
| SEQ ID NO: 873 | gp100 segment 20 | 90 | nts |
| SEQ ID NO: 874 | Polypeptide encoded by SEQ ID NO: 873 | 30 | aa |
| SEQ ID NO: 875 | gp100 segment 21 | 90 | nts |
| SEQ ID NO: 876 | Polypeptide encoded by SEQ ID NO: 875 | 30 | aa |
| SEQ ID NO: 877 | gp100 segment 22 | 90 | nts |
| SEQ ID NO: 878 | Polypeptide encoded by SEQ ID NO: 877 | 30 | aa |
| SEQ ID NO: 879 | gp100 segment 23 | 90 | nts |
| SEQ ID NO: 880 | Polypeptide encoded by SEQ ID NO: 879 | 30 | aa |
| SEQ ID NO: 881 | gp100 segment 24 | 90 | nts |
| SEQ ID NO: 882 | Polypeptide encoded by SEQ ID NO: 881 | 30 | aa |
| SEQ ID NO: 883 | gp100 segment 25 | 90 | nts |
| SEQ ID NO: 884 | Polypeptide encoded by SEQ ID NO: 883 | 30 | aa |
| SEQ ID NO: 885 | gp100 segment 26 | 90 | nts |
| SEQ ID NO: 886 | Polypeptide encoded by SEQ ID NO: 885 | 30 | aa |
| SEQ ID NO: 887 | gp100 segment 27 | 90 | nts |
| SEQ ID NO: 888 | Polypeptide encoded by SEQ ID NO: 887 | 30 | aa |
| SEQ ID NO: 889 | gp100 segment 28 | 90 | nts |
| SEQ ID NO: 890 | Polypeptide encoded by SEQ ID NO: 889 | 30 | aa |
| SEQ ID NO: 891 | gp100 segment 29 | 90 | nts |
| SEQ ID NO: 892 | Polypeptide encoded by SEQ ID NO: 891 | 30 | aa |
| SEQ ID NO: 893 | gp100 segment 30 | 90 | nts |
| SEQ ID NO: 894 | Polypeptide encoded by SEQ ID NO: 893 | 30 | aa |
| SEQ ID NO: 895 | gp100 segment 31 | 90 | nts |
| SEQ ID NO: 896 | Polypeptide encoded by SEQ ID NO: 895 | 30 | aa |
| SEQ ID NO: 897 | gp100 segment 32 | 90 | nts |
| SEQ ID NO: 898 | Polypeptide encoded by SEQ ID NO: 897 | 30 | aa |
| SEQ ID NO: 899 | gp100 segment 33 | 90 | nts |
| SEQ ID NO: 900 | Polypeptide encoded by SEQ ID NO: 899 | 30 | aa |
| SEQ ID NO: 901 | gp100 segment 34 | 90 | nts |
| SEQ ID NO: 902 | Polypeptide encoded by SEQ ID NO: 901 | 30 | aa |
| SEQ ID NO: 903 | gp100 segment 35 | 90 | nts |
| SEQ ID NO: 904 | Polypeptide encoded by SEQ ID NO: 903 | 30 | aa |
| SEQ ID NO: 905 | gp100 segment 36 | 90 | nts |
| SEQ ID NO: 906 | Polypeptide encoded by SEQ ID NO: 905 | 30 | aa |
| SEQ ID NO: 907 | gp100 segment 37 | 90 | nts |
| SEQ ID NO: 908 | Polypeptide encoded by SEQ ID NO: 907 | 30 | aa |
| SEQ ID NO: 909 | gp100 segment 38 | 90 | nts |
| SEQ ID NO: 910 | Polypeptide encoded by SEQ ID NO: 909 | 30 | aa |
| SEQ ID NO: 911 | gp100 segment 39 | 90 | nts |
| SEQ ID NO: 912 | Polypeptide encoded by SEQ ID NO: 911 | 30 | aa |
| SEQ ID NO: 913 | gp100 segment 40 | 90 | nts |
| SEQ ID NO: 914 | Polypeptide encoded by SEQ ID NO: 913 | 30 | aa |
| SEQ ID NO: 915 | gp100 segment 41 | 90 | nts |
| SEQ ID NO: 916 | Polypeptide encoded by SEQ ID NO: 915 | 30 | aa |
| SEQ ID NO: 917 | gp100 segment 42 | 90 | nts |
| SEQ ID NO: 918 | Polypeptide encoded by SEQ ID NO: 917 | 30 | aa |
| SEQ ID NO: 919 | gp100 segment 43 | 90 | nts |
| SEQ ID NO: 920 | Polypeptide encoded by SEQ ID NO: 919 | 30 | aa |
| SEQ ID NO: 921 | gp100 segment 44 | 60 | nts |
| SEQ ID NO: 922 | Polypeptide encoded by SEQ ID NO: 921 | 20 | aa |
| SEQ ID NO: 923 | MART segment 1 | 90 | nts |
| SEQ ID NO: 924 | Polypeptide encoded by SEQ ID NO: 923 | 30 | aa |
| SEQ ID NO: 925 | MART segment 2 | 90 | nts |
| SEQ ID NO: 926 | Polypeptide encoded by SEQ ID NO: 925 | 30 | aa |

TABLE A-continued

| SEQUENCE ID NUMBER | SEQUENCE | Length | |
|---|---|---|---|
| SEQ ID NO: 927 | MART segment 3 | 90 | nts |
| SEQ ID NO: 928 | Polypeptide encoded by SEQ ID NO: 927 | 30 | aa |
| SEQ ID NO: 929 | MART segment 4 | 90 | nts |
| SEQ ID NO: 930 | Polypeptide encoded by SEQ ID NO: 929 | 30 | aa |
| SEQ ID NO: 931 | MART segment 5 | 90 | nts |
| SEQ ID NO: 932 | Polypeptide encoded by SEQ ID NO: 931 | 30 | aa |
| SEQ ID NO: 933 | MART segment 6 | 90 | nts |
| SEQ ID NO: 934 | Polypeptide encoded by SEQ ID NO: 933 | 30 | aa |
| SEQ ID NO: 935 | MART segment 7 | 90 | nts |
| SEQ ID NO: 936 | Polypeptide encoded by SEQ ID NO: 935 | 30 | aa |
| SEQ ID NO: 937 | MART segment 8 | 51 | nts |
| SEQ ID NO: 938 | Polypeptide encoded by SEQ ID NO: 937 | 17 | aa |
| SEQ ID NO: 939 | trp-1 segment 1 | 90 | nts |
| SEQ ID NO: 940 | Polypeptide encoded by SEQ ID NO: 939 | 30 | aa |
| SEQ ID NO: 941 | trp-1 segment 2 | 90 | nts |
| SEQ ID NO: 942 | Polypeptide encoded by SEQ ID NO: 941 | 30 | aa |
| SEQ ID NO: 943 | trp-1 segment 3 | 90 | nts |
| SEQ ID NO: 944 | Polypeptide encoded by SEQ ID NO: 943 | 30 | aa |
| SEQ ID NO: 945 | trp-1 segment 4 | 90 | nts |
| SEQ ID NO: 946 | Polypeptide encoded by SEQ ID NO: 945 | 30 | aa |
| SEQ ID NO: 947 | trp-1 segment 5 | 90 | nts |
| SEQ ID NO: 948 | Polypeptide encoded by SEQ ID NO: 947 | 30 | aa |
| SEQ ID NO: 949 | trp-1 segment 6 | 90 | nts |
| SEQ ID NO: 950 | Polypeptide encoded by SEQ ID NO: 949 | 30 | aa |
| SEQ ID NO: 951 | trp-1 segment 7 | 90 | nts |
| SEQ ID NO: 952 | Polypeptide encoded by SEQ ID NO: 951 | 30 | aa |
| SEQ ID NO: 953 | trp-1 segment 8 | 90 | nts |
| SEQ ID NO: 954 | Polypeptide encoded by SEQ ID NO: 953 | 30 | aa |
| SEQ ID NO: 955 | trp-1 segment 9 | 90 | nts |
| SEQ ID NO: 956 | Polypeptide encoded by SEQ ID NO: 955 | 30 | aa |
| SEQ ID NO: 957 | trp-1 segment 10 | 90 | nts |
| SEQ ID NO: 958 | Polypeptide encoded by SEQ ID NO: 957 | 30 | aa |
| SEQ ID NO: 959 | trp-1 segment 11 | 90 | nts |
| SEQ ID NO: 960 | Polypeptide encoded by SEQ ID NO: 959 | 30 | aa |
| SEQ ID NO: 961 | trp-1 segment 12 | 90 | nts |
| SEQ ID NO: 962 | Polypeptide encoded by SEQ ID NO: 961 | 30 | aa |
| SEQ ID NO: 963 | trp-1 segment 13 | 90 | nts |
| SEQ ID NO: 964 | Polypeptide encoded by SEQ ID NO: 963 | 30 | aa |
| SEQ ID NO: 965 | trp-1 segment 14 | 90 | nts |
| SEQ ID NO: 966 | Polypeptide encoded by SEQ ID NO: 965 | 30 | aa |
| SEQ ID NO: 967 | trp-1 segment 15 | 90 | nts |
| SEQ ID NO: 968 | Polypeptide encoded by SEQ ID NO: 967 | 30 | aa |
| SEQ ID NO: 969 | trp-1 segment 16 | 81 | nts |
| SEQ ID NO: 970 | Polypeptide encoded by SEQ ID NO: 969 | 27 | aa |
| SEQ ID NO: 971 | tyros segment 1 | 90 | nts |
| SEQ ID NO: 972 | Polypeptide encoded by SEQ ID NO: 971 | 30 | aa |
| SEQ ID NO: 973 | tyros segment 2 | 90 | nts |
| SEQ ID NO: 974 | Polypeptide encoded by SEQ ID NO: 973 | 30 | aa |
| SEQ ID NO: 975 | tyros segment 3 | 90 | nts |
| SEQ ID NO: 976 | Polypeptide encoded by SEQ ID NO: 975 | 30 | aa |
| SEQ ID NO: 977 | tyros segment 4 | 90 | nts |
| SEQ ID NO: 978 | Polypeptide encoded by SEQ ID NO: 977 | 30 | aa |
| SEQ ID NO: 979 | tyros segment 5 | 90 | nts |
| SEQ ID NO: 980 | Polypeptide encoded by SEQ ID NO: 979 | 30 | aa |
| SEQ ID NO: 981 | tyros segment 6 | 90 | nts |
| SEQ ID NO: 982 | Polypeptide encoded by SEQ ID NO: 981 | 30 | aa |
| SEQ ID NO: 983 | tyros segment 7 | 90 | nts |
| SEQ ID NO: 984 | Polypeptide encoded by SEQ ID NO: 983 | 30 | aa |
| SEQ ID NO: 985 | tyros segment 8 | 90 | nts |
| SEQ ID NO: 986 | Polypeptide encoded by SEQ ID NO: 985 | 30 | aa |
| SEQ ID NO: 987 | tyros segment 9 | 90 | nts |
| SEQ ID NO: 988 | Polypeptide encoded by SEQ ID NO: 987 | 30 | aa |
| SEQ ID NO: 989 | tyros segment 10 | 90 | nts |
| SEQ ID NO: 990 | Polypeptide encoded by SEQ ID NO: 989 | 30 | aa |
| SEQ ID NO: 991 | tyros segment 11 | 90 | nts |
| SEQ ID NO: 992 | Polypeptide encoded by SEQ ID NO: 991 | 30 | aa |
| SEQ ID NO: 993 | tyros segment 12 | 90 | nts |
| SEQ ID NO: 994 | Polypeptide encoded by SEQ ID NO: 993 | 30 | aa |
| SEQ ID NO: 995 | tyros segment 13 | 90 | nts |
| SEQ ID NO: 996 | Polypeptide encoded by SEQ ID NO: 995 | 30 | aa |
| SEQ ID NO: 997 | tyros segment 14 | 90 | nts |
| SEQ ID NO: 998 | Polypeptide encoded by SEQ ID NO: 997 | 30 | aa |
| SEQ ID NO: 999 | tyros segment 15 | 90 | nts |
| SEQ ID NO: 1000 | Polypeptide encoded by SEQ ID NO: 999 | 30 | aa |
| SEQ ID NO: 1001 | tyros segment 16 | 90 | nts |
| SEQ ID NO: 1002 | Polypeptide encoded by SEQ ID NO: 1001 | 30 | aa |

TABLE A-continued

| SEQUENCE ID NUMBER | SEQUENCE | Length | |
|---|---|---|---|
| SEQ ID NO: 1003 | tyros segment 17 | 90 | nts |
| SEQ ID NO: 1004 | Polypeptide encoded by SEQ ID NO: 1003 | 30 | aa |
| SEQ ID NO: 1005 | tyros segment 18 | 90 | nts |
| SEQ ID NO: 1006 | Polypeptide encoded by SEQ ID NO: 1005 | 30 | aa |
| SEQ ID NO: 1007 | tyros segment 19 | 90 | nts |
| SEQ ID NO: 1008 | Polypeptide encoded by SEQ ID NO: 1007 | 30 | aa |
| SEQ ID NO: 1009 | tyros segment 20 | 90 | nts |
| SEQ ID NO: 1010 | Polypeptide encoded by SEQ ID NO: 1009 | 30 | aa |
| SEQ ID NO: 1011 | tyros segment 21 | 90 | nts |
| SEQ ID NO: 1012 | Polypeptide encoded by SEQ ID NO: 1011 | 30 | aa |
| SEQ ID NO: 1013 | tyros segment 22 | 90 | nts |
| SEQ ID NO: 1014 | Polypeptide encoded by SEQ ID NO: 1013 | 30 | aa |
| SEQ ID NO: 1015 | tyros segment 23 | 90 | nts |
| SEQ ID NO: 1016 | Polypeptide encoded by SEQ ID NO: 1015 | 30 | aa |
| SEQ ID NO: 1017 | tyros segment 24 | 90 | nts |
| SEQ ID NO: 1018 | Polypeptide encoded by SEQ ID NO: 1017 | 30 | aa |
| SEQ ID NO: 1019 | tyros segment 25 | 90 | nts |
| SEQ ID NO: 1020 | Polypeptide encoded by SEQ ID NO: 1019 | 30 | aa |
| SEQ ID NO: 1021 | tyros segment 26 | 90 | nts |
| SEQ ID NO: 1022 | Polypeptide encoded by SEQ ID NO: 1021 | 30 | aa |
| SEQ ID NO: 1023 | tyros segment 27 | 90 | nts |
| SEQ ID NO: 1024 | Polypeptide encoded by SEQ ID NO: 1023 | 30 | aa |
| SEQ ID NO: 1025 | tyros segment 28 | 90 | nts |
| SEQ ID NO: 1026 | Polypeptide encoded by SEQ ID NO: 1025 | 30 | aa |
| SEQ ID NO: 1027 | tyros segment 29 | 90 | nts |
| SEQ ID NO: 1028 | Polypeptide encoded by SEQ ID NO: 1027 | 30 | aa |
| SEQ ID NO: 1029 | tyros segment 30 | 90 | nts |
| SEQ ID NO: 1030 | Polypeptide encoded by SEQ ID NO: 1029 | 30 | aa |
| SEQ ID NO: 1031 | tyros segment 31 | 90 | nts |
| SEQ ID NO: 1032 | Polypeptide encoded by SEQ ID NO: 1031 | 30 | aa |
| SEQ ID NO: 1033 | tyros segment 32 | 90 | nts |
| SEQ ID NO: 1034 | Polypeptide encoded by SEQ ID NO: 1033 | 30 | aa |
| SEQ ID NO: 1035 | tyros segment 33 | 90 | nts |
| SEQ ID NO: 1036 | Polypeptide encoded by SEQ ID NO: 1035 | 30 | aa |
| SEQ ID NO: 1037 | tyros segment 34 | 90 | nts |
| SEQ ID NO: 1038 | Polypeptide encoded by SEQ ID NO: 1037 | 30 | aa |
| SEQ ID NO: 1039 | tyros segment 35 | 69 | nts |
| SEQ ID NO: 1040 | Polypeptide encoded by SEQ ID NO: 1039 | 23 | aa |
| SEQ ID NO: 1041 | trp2 segment 1 | 90 | nts |
| SEQ ID NO: 1042 | Polypeptide encoded by SEQ ID NO: 1041 | 30 | aa |
| SEQ ID NO: 1043 | trp2 segment 2 | 90 | nts |
| SEQ ID NO: 1044 | Polypeptide encoded by SEQ ID NO: 1043 | 30 | aa |
| SEQ ID NO: 1045 | trp2 segment 3 | 90 | nts |
| SEQ ID NO: 1046 | Polypeptide encoded by SEQ ID NO: 1045 | 30 | aa |
| SEQ ID NO: 1047 | trp2 segment 4 | 90 | nts |
| SEQ ID NO: 1048 | Polypeptide encoded by SEQ ID NO: 1047 | 30 | aa |
| SEQ ID NO: 1049 | trp2 segment 5 | 90 | nts |
| SEQ ID NO: 1050 | Polypeptide encoded by SEQ ID NO: 1049 | 30 | aa |
| SEQ ID NO: 1051 | trp2 segment 6 | 90 | nts |
| SEQ ID NO: 1052 | Polypeptide encoded by SEQ ID NO: 1051 | 30 | aa |
| SEQ ID NO: 1053 | trp2 segment 7 | 90 | nts |
| SEQ ID NO: 1054 | Polypeptide encoded by SEQ ID NO: 1053 | 30 | aa |
| SEQ ID NO: 1055 | trp2 segment 8 | 90 | nts |
| SEQ ID NO: 1056 | Polypeptide encoded by SEQ ID NO: 1055 | 30 | aa |
| SEQ ID NO: 1057 | trp2 segment 9 | 90 | nts |
| SEQ ID NO: 1058 | Polypeptide encoded by SEQ ID NO: 1057 | 30 | aa |
| SEQ ID NO: 1059 | trp2 segment 10 | 90 | nts |
| SEQ ID NO: 1060 | Polypeptide encoded by SEQ ID NO: 1059 | 30 | aa |
| SEQ ID NO: 1061 | trp2 segment 11 | 90 | nts |
| SEQ ID NO: 1062 | Polypeptide encoded by SEQ ID NO: 1061 | 30 | aa |
| SEQ ID NO: 1063 | trp2 segment 12 | 90 | nts |
| SEQ ID NO: 1064 | Polypeptide encoded by SEQ ID NO: 1063 | 30 | aa |
| SEQ ID NO: 1065 | trp2 segment 13 | 90 | nts |
| SEQ ID NO: 1066 | Polypeptide encoded by SEQ ID NO: 1065 | 30 | aa |
| SEQ ID NO: 1067 | trp2 segment 14 | 90 | nts |
| SEQ ID NO: 1068 | Polypeptide encoded by SEQ ID NO: 1067 | 30 | aa |
| SEQ ID NO: 1069 | trp2 segment 15 | 90 | nts |
| SEQ ID NO: 1070 | Polypeptide encoded by SEQ ID NO: 1069 | 30 | aa |
| SEQ ID NO: 1071 | trp2 segment 16 | 90 | nts |
| SEQ ID NO: 1072 | Polypeptide encoded by SEQ ID NO: 1071 | 30 | aa |
| SEQ ID NO: 1073 | trp2 segment 17 | 90 | nts |
| SEQ ID NO: 1074 | Polypeptide encoded by SEQ ID NO: 1073 | 30 | aa |
| SEQ ID NO: 1075 | trp2 segment 18 | 90 | nts |
| SEQ ID NO: 1076 | Polypeptide encoded by SEQ ID NO: 1075 | 30 | aa |
| SEQ ID NO: 1077 | trp2 segment 19 | 90 | nts |
| SEQ ID NO: 1078 | Polypeptide encoded by SEQ ID NO: 1077 | 30 | aa |

TABLE A-continued

| SEQUENCE ID NUMBER | SEQUENCE | Length | |
|---|---|---|---|
| SEQ ID NO: 1079 | trp2 segment 20 | 90 | nts |
| SEQ ID NO: 1080 | Polypeptide encoded by SEQ ID NO: 1079 | 30 | aa |
| SEQ ID NO: 1081 | trp2 segment 21 | 90 | nts |
| SEQ ID NO: 1082 | Polypeptide encoded by SEQ ID NO: 1081 | 30 | aa |
| SEQ ID NO: 1083 | trp2 segment 22 | 90 | nts |
| SEQ ID NO: 1084 | Polypeptide encoded by SEQ ID NO: 1083 | 30 | aa |
| SEQ ID NO: 1085 | trp2 segment 23 | 90 | nts |
| SEQ ID NO: 1086 | Polypeptide encoded by SEQ ID NO: 1085 | 30 | aa |
| SEQ ID NO: 1087 | trp2 segment 24 | 90 | nts |
| SEQ ID NO: 1088 | Polypeptide encoded by SEQ ID NO: 1087 | 30 | aa |
| SEQ ID NO: 1089 | trp2 segment 25 | 90 | nts |
| SEQ ID NO: 1090 | Polypeptide encoded by SEQ ID NO: 1089 | 30 | aa |
| SEQ ID NO: 1091 | trp2 segment 26 | 90 | nts |
| SEQ ID NO: 1092 | Polypeptide encoded by SEQ ID NO: 1091 | 30 | aa |
| SEQ ID NO: 1093 | trp2 segment 27 | 90 | nts |
| SEQ ID NO: 1094 | Polypeptide encoded by SEQ ID NO: 1093 | 30 | aa |
| SEQ ID NO: 1095 | trp2 segment 28 | 90 | nts |
| SEQ ID NO: 1096 | Polypeptide encoded by SEQ ID NO: 1095 | 30 | aa |
| SEQ ID NO: 1097 | trp2 segment 29 | 90 | nts |
| SEQ ID NO: 1098 | Polypeptide encoded by SEQ ID NO: 1097 | 30 | aa |
| SEQ ID NO: 1099 | trp2 segment 30 | 90 | nts |
| SEQ ID NO: 1100 | Polypeptide encoded by SEQ ID NO: 1099 | 30 | aa |
| SEQ ID NO: 1101 | trp2 segment 31 | 90 | nts |
| SEQ ID NO: 1102 | Polypeptide encoded by SEQ ID NO: 1101 | 30 | aa |
| SEQ ID NO: 1103 | trp2 segment 32 | 90 | nts |
| SEQ ID NO: 1104 | Polypeptide encoded by SEQ ID NO: 1103 | 30 | aa |
| SEQ ID NO: 1105 | trp2 segment 33 | 90 | nts |
| SEQ ID NO: 1106 | Polypeptide encoded by SEQ ID NO: 1105 | 30 | aa |
| SEQ ID NO: 1107 | trp2 segment 34 | 84 | nts |
| SEQ ID NO: 1108 | Polypeptide encoded by SEQ ID NO: 1107 | 28 | aa |
| SEQ ID NO: 1109 | MC1R segment 1 | 90 | nts |
| SEQ ID NO: 1110 | Polypeptide encoded by SEQ ID NO: 1109 | 30 | aa |
| SEQ ID NO: 1111 | MC1R segment 2 | 90 | nts |
| SEQ ID NO: 1112 | Polypeptide encoded by SEQ ID NO: 1111 | 30 | aa |
| SEQ ID NO: 1113 | MC1R segment 3 | 90 | nts |
| SEQ ID NO: 1114 | Polypeptide encoded by SEQ ID NO: 1113 | 30 | aa |
| SEQ ID NO: 1115 | MC1R segment 4 | 90 | nts |
| SEQ ID NO: 1116 | Polypeptide encoded by SEQ ID NO: 1115 | 30 | aa |
| SEQ ID NO: 1117 | MC1R segment 5 | 90 | nts |
| SEQ ID NO: 1118 | Polypeptide encoded by SEQ ID NO: 1117 | 30 | aa |
| SEQ ID NO: 1119 | MC1R segment 6 | 90 | nts |
| SEQ ID NO: 1120 | Polypeptide encoded by SEQ ID NO: 1119 | 30 | aa |
| SEQ ID NO: 1121 | MC1R segment 7 | 90 | nts |
| SEQ ID NO: 1122 | Polypeptide encoded by SEQ ID NO: 1121 | 30 | aa |
| SEQ ID NO: 1123 | MC1R segment 8 | 90 | nts |
| SEQ ID NO: 1124 | Polypeptide encoded by SEQ ID NO: 1123 | 30 | aa |
| SEQ ID NO: 1125 | MC1R segment 9 | 90 | nts |
| SEQ ID NO: 1126 | Polypeptide encoded by SEQ ID NO: 1125 | 30 | aa |
| SEQ ID NO: 1127 | MC1R segment 10 | 90 | nts |
| SEQ ID NO: 1128 | Polypeptide encoded by SEQ ID NO: 1127 | 30 | aa |
| SEQ ID NO: 1129 | MC1R segment 11 | 90 | nts |
| SEQ ID NO: 1130 | Polypeptide encoded by SEQ ID NO: 1129 | 30 | aa |
| SEQ ID NO: 1131 | MC1R segment 12 | 90 | nts |
| SEQ ID NO: 1132 | Polypeptide encoded by SEQ ID NO: 1131 | 30 | aa |
| SEQ ID NO: 1133 | MC1R segment 13 | 90 | nts |
| SEQ ID NO: 1134 | Polypeptide encoded by SEQ ID NO: 1133 | 30 | aa |
| SEQ ID NO: 1135 | MC1R segment 14 | 90 | nts |
| SEQ ID NO: 1136 | Polypeptide encoded by SEQ ID NO: 1135 | 30 | aa |
| SEQ ID NO: 1137 | MC1R segment 15 | 90 | nts |
| SEQ ID NO: 1138 | Polypeptide encoded by SEQ ID NO: 1137 | 30 | aa |
| SEQ ID NO: 1139 | MC1R segment 16 | 90 | nts |
| SEQ ID NO: 1140 | Polypeptide encoded by SEQ ID NO: 1139 | 30 | aa |
| SEQ ID NO: 1141 | MC1R segment 17 | 90 | nts |
| SEQ ID NO: 1142 | Polypeptide encoded by SEQ ID NO: 1141 | 30 | aa |
| SEQ ID NO: 1143 | MC1R segment 18 | 90 | nts |
| SEQ ID NO: 1144 | Polypeptide encoded by SEQ ID NO: 1143 | 30 | aa |
| SEQ ID NO: 1145 | MC1R segment 19 | 90 | nts |
| SEQ ID NO: 1146 | Polypeptide encoded by SEQ ID NO: 1145 | 30 | aa |
| SEQ ID NO: 1147 | MC1R segment 20 | 90 | nts |
| SEQ ID NO: 1148 | Polypeptide encoded by SEQ ID NO: 1147 | 30 | aa |
| SEQ ID NO: 1149 | MC1R segment 21 | 63 | nts |
| SEQ ID NO: 1150 | Polypeptide encoded by SEQ ID NO: 1149 | 21 | aa |
| SEQ ID NO: 1151 | MUC1F segment 1 | 90 | nts |
| SEQ ID NO: 1152 | Polypeptide encoded by SEQ ID NO: 1151 | 30 | aa |
| SEQ ID NO: 1153 | MUC1F segment 2 | 90 | nts |
| SEQ ID NO: 1154 | Polypeptide encoded by SEQ ID NO: 1153 | 30 | aa |

TABLE A-continued

| SEQUENCE ID NUMBER | SEQUENCE | Length | |
|---|---|---|---|
| SEQ ID NO: 1155 | MUC1F segment 3 | 90 | nts |
| SEQ ID NO: 1156 | Polypeptide encoded by SEQ ID NO: 1155 | 30 | aa |
| SEQ ID NO: 1157 | MUC1F segment 4 | 90 | nts |
| SEQ ID NO: 1158 | Polypeptide encoded by SEQ ID NO: 1157 | 30 | aa |
| SEQ ID NO: 1159 | MUC1F segment 5 | 90 | nts |
| SEQ ID NO: 1160 | Polypeptide encoded by SEQ ID NO: 1159 | 30 | aa |
| SEQ ID NO: 1161 | MUC1F segment 6 | 90 | nts |
| SEQ ID NO: 1162 | Polypeptide encoded by SEQ ID NO: 1161 | 30 | aa |
| SEQ ID NO: 1163 | MUC1F segment 7 | 90 | nts |
| SEQ ID NO: 1164 | Polypeptide encoded by SEQ ID NO: 1163 | 30 | aa |
| SEQ ID NO: 1165 | MUC1F segment 8 | 72 | nts |
| SEQ ID NO: 1166 | Polypeptide encoded by SEQ ID NO: 1165 | 24 | aa |
| SEQ ID NO: 1167 | MUC1R segment 1 | 90 | nts |
| SEQ ID NO: 1168 | Polypeptide encoded by SEQ ID NO: 1167 | 30 | aa |
| SEQ ID NO: 1169 | MUC1R segment 2 | 90 | nts |
| SEQ ID NO: 1170 | Polypeptide encoded by SEQ ID NO: 1169 | 30 | aa |
| SEQ ID NO: 1171 | MUC1R segment 3 | 90 | nts |
| SEQ ID NO: 1172 | Polypeptide encoded by SEQ ID NO: 1171 | 30 | aa |
| SEQ ID NO: 1173 | MUC1R segment 4 | 90 | nts |
| SEQ ID NO: 1174 | Polypeptide encoded by SEQ ID NO: 1173 | 30 | aa |
| SEQ ID NO: 1175 | MUC1R segment 5 | 90 | nts |
| SEQ ID NO: 1176 | Polypeptide encoded by SEQ ID NO: 1175 | 30 | aa |
| SEQ ID NO: 1177 | MUC1R segment 6 | 90 | nts |
| SEQ ID NO: 1178 | Polypeptide encoded by SEQ ID NO: 1177 | 30 | aa |
| SEQ ID NO: 1179 | MUC1R segment 7 | 90 | nts |
| SEQ ID NO: 1180 | Polypeptide encoded by SEQ ID NO: 1179 | 30 | aa |
| SEQ ID NO: 1181 | MUC1R segment 8 | 90 | nts |
| SEQ ID NO: 1182 | Polypeptide encoded by SEQ ID NO: 1181 | 30 | aa |
| SEQ ID NO: 1183 | MUC1R segment 9 | 90 | nts |
| SEQ ID NO: 1184 | Polypeptide encoded by SEQ ID NO: 1183 | 30 | aa |
| SEQ ID NO: 1185 | MUC1R segment 10 | 90 | nts |
| SEQ ID NO: 1186 | Polypeptide encoded by SEQ ID NO: 1185 | 30 | aa |
| SEQ ID NO: 1187 | MUC1R segment 11 | 90 | nts |
| SEQ ID NO: 1188 | Polypeptide encoded by SEQ ID NO: 1187 | 30 | aa |
| SEQ ID NO: 1189 | MUC1R segment 12 | 90 | nts |
| SEQ ID NO: 1190 | Polypeptide encoded by SEQ ID NO: 1189 | 30 | aa |
| SEQ ID NO: 1191 | MUC1R segment 13 | 90 | nts |
| SEQ ID NO: 1192 | Polypeptide encoded by SEQ ID NO: 1191 | 30 | aa |
| SEQ ID NO: 1193 | MUC1R segment 14 | 90 | nts |
| SEQ ID NO: 1194 | Polypeptide encoded by SEQ ID NO: 1193 | 30 | aa |
| SEQ ID NO: 1195 | MUC1R segment 15 | 90 | nts |
| SEQ ID NO: 1196 | Polypeptide encoded by SEQ ID NO: 1195 | 30 | aa |
| SEQ ID NO: 1197 | MUC1R segment 16 | 90 | nts |
| SEQ ID NO: 1198 | Polypeptide encoded by SEQ ID NO: 1197 | 30 | aa |
| SEQ ID NO: 1199 | MUC1R segment 17 | 90 | nts |
| SEQ ID NO: 1200 | Polypeptide encoded by SEQ ID NO: 1199 | 30 | aa |
| SEQ ID NO: 1201 | MUC1R segment 18 | 90 | nts |
| SEQ ID NO: 1202 | Polypeptide encoded by SEQ ID NO: 1201 | 30 | aa |
| SEQ ID NO: 1203 | MUC1R segment 19 | 90 | nts |
| SEQ ID NO: 1204 | Polypeptide encoded by SEQ ID NO: 1203 | 30 | aa |
| SEQ ID NO: 1205 | MUC1R segment 20 | 90 | nts |
| SEQ ID NO: 1206 | Polypeptide encoded by SEQ ID NO: 1205 | 30 | aa |
| SEQ ID NO: 1207 | MUC1R segment 21 | 48 | nts |
| SEQ ID NO: 1208 | Polypeptide encoded by SEQ ID NO: 1207 | 16 | aa |
| SEQ ID NO: 1209 | Differentiation Savine | 16638 | nts |
| SEQ ID NO: 1210 | Polypeptide encoded by SEQ ID NO: 1209 | 5546 | aa |
| SEQ ID NO: 1211 | BAGE segment 1 | 90 | nts |
| SEQ ID NO: 1212 | Polypeptide encoded by SEQ ID NO: 1211 | 30 | aa |
| SEQ ID NO: 1213 | BAGE segment 2 | 90 | nts |
| SEQ ID NO: 1214 | Polypeptide encoded by SEQ ID NO: 1213 | 30 | aa |
| SEQ ID NO: 1215 | BAGE segment 3 | 51 | nts |
| SEQ ID NO: 1216 | Polypeptide encoded by SEQ ID NO: 1215 | 17 | aa |
| SEQ ID NO: 1217 | GAGE-1 segment 1 | 90 | nts |
| SEQ ID NO: 1218 | Polypeptide encoded by SEQ ID NO: 1217 | 30 | aa |
| SEQ ID NO: 1219 | GAGE-1 segment 2 | 90 | nts |
| SEQ ID NO: 1220 | Polypeptide encoded by SEQ ID NO: 1219 | 30 | aa |
| SEQ ID NO: 1221 | GAGE-1 segment 3 | 90 | nts |
| SEQ ID NO: 1222 | Polypeptide encoded by SEQ ID NO: 1221 | 30 | aa |
| SEQ ID NO: 1223 | GAGE-1 segment 4 | 90 | nts |
| SEQ ID NO: 1224 | Polypeptide encoded by SEQ ID NO: 1223 | 30 | aa |
| SEQ ID NO: 1225 | GAGE-1 segment 5 | 90 | nts |
| SEQ ID NO: 1226 | Polypeptide encoded by SEQ ID NO: 1225 | 30 | aa |
| SEQ ID NO: 1227 | GAGE-1 segment 6 | 90 | nts |
| SEQ ID NO: 1228 | Polypeptide encoded by SEQ ID NO: 1227 | 30 | aa |
| SEQ ID NO: 1229 | GAGE-1 segment 7 | 90 | nts |
| SEQ ID NO: 1230 | Polypeptide encoded by SEQ ID NO: 1229 | 30 | aa |

TABLE A-continued

| SEQUENCE ID NUMBER | SEQUENCE | Length | |
|---|---|---|---|
| SEQ ID NO: 1231 | GAGE-1 segment 8 | 90 | nts |
| SEQ ID NO: 1232 | Polypeptide encoded by SEQ ID NO: 1231 | 30 | aa |
| SEQ ID NO: 1233 | GAGE-1 segment 9 | 66 | nts |
| SEQ ID NO: 1234 | Polypeptide encoded by SEQ ID NO: 1233 | 22 | aa |
| SEQ ID NO: 1235 | gp1001n4 segment 1 | 90 | nts |
| SEQ ID NO: 1236 | Polypeptide encoded by SEQ ID NO: 1235 | 30 | aa |
| SEQ ID NO: 1237 | gp1001n4 segment 2 | 90 | nts |
| SEQ ID NO: 1238 | Polypeptide encoded by SEQ ID NO: 1237 | 30 | aa |
| SEQ ID NO: 1239 | gp1001n4 segment 3 | 75 | nts |
| SEQ ID NO: 1240 | Polypeptide encoded by SEQ ID NO: 1239 | 25 | aa |
| SEQ ID NO: 1241 | MAGE-1 segment 1 | 90 | nts |
| SEQ ID NO: 1242 | Polypeptide encoded by SEQ ID NO: 1241 | 30 | aa |
| SEQ ID NO: 1243 | MAGE-1 segment 2 | 90 | nts |
| SEQ ID NO: 1244 | Polypeptide encoded by SEQ ID NO: 1243 | 30 | aa |
| SEQ ID NO: 1245 | MAGE-1 segment 3 | 90 | nts |
| SEQ ID NO: 1246 | Polypeptide encoded by SEQ ID NO: 1245 | 30 | aa |
| SEQ ID NO: 1247 | MAGE-1 segment 4 | 90 | nts |
| SEQ ID NO: 1248 | Polypeptide encoded by SEQ ID NO: 1247 | 30 | aa |
| SEQ ID NO: 1249 | MAGE-1 segment 5 | 90 | nts |
| SEQ ID NO: 1250 | Polypeptide encoded by SEQ ID NO: 1249 | 30 | aa |
| SEQ ID NO: 1251 | MAGE-1 segment 6 | 90 | nts |
| SEQ ID NO: 1252 | Polypeptide encoded by SEQ ID NO: 1251 | 30 | aa |
| SEQ ID NO: 1253 | MAGE-1 segment 7 | 90 | nts |
| SEQ ID NO: 1254 | Polypeptide encoded by SEQ ID NO: 1253 | 30 | aa |
| SEQ ID NO: 1255 | MAGE-1 segment 8 | 90 | nts |
| SEQ ID NO: 1256 | Polypeptide encoded by SEQ ID NO: 1255 | 30 | aa |
| SEQ ID NO: 1257 | MAGE-1 segment 9 | 90 | nts |
| SEQ ID NO: 1258 | Polypeptide encoded by SEQ ID NO: 1257 | 30 | aa |
| SEQ ID NO: 1259 | MAGE-1 segment 10 | 90 | nts |
| SEQ ID NO: 1260 | Polypeptide encoded by SEQ ID NO: 1259 | 30 | aa |
| SEQ ID NO: 1261 | MAGE-1 segment 11 | 90 | nts |
| SEQ ID NO: 1262 | Polypeptide encoded by SEQ ID NO: 1261 | 30 | aa |
| SEQ ID NO: 1263 | MAGE-1 segment 12 | 90 | nts |
| SEQ ID NO: 1264 | Polypeptide encoded by SEQ ID NO: 1263 | 30 | aa |
| SEQ ID NO: 1265 | MAGE-1 segment 13 | 90 | nts |
| SEQ ID NO: 1266 | Polypeptide encoded by SEQ ID NO: 1265 | 30 | aa |
| SEQ ID NO: 1267 | MAGE-1 segment 14 | 90 | nts |
| SEQ ID NO: 1268 | Polypeptide encoded by SEQ ID NO: 1267 | 30 | aa |
| SEQ ID NO: 1269 | MAGE-1 segment 15 | 90 | nts |
| SEQ ID NO: 1270 | Polypeptide encoded by SEQ ID NO: 1269 | 30 | aa |
| SEQ ID NO: 1271 | MAGE-1 segment 16 | 90 | nts |
| SEQ ID NO: 1272 | Polypeptide encoded by SEQ ID NO: 1271 | 30 | aa |
| SEQ ID NO: 1273 | MAGE-1 segment 17 | 90 | nts |
| SEQ ID NO: 1274 | Polypeptide encoded by SEQ ID NO: 1273 | 30 | aa |
| SEQ ID NO: 1275 | MAGE-1 segment 18 | 90 | nts |
| SEQ ID NO: 1276 | Polypeptide encoded by SEQ ID NO: 1275 | 30 | aa |
| SEQ ID NO: 1277 | MAGE-1 segment 19 | 90 | nts |
| SEQ ID NO: 1278 | Polypeptide encoded by SEQ ID NO: 1277 | 30 | aa |
| SEQ ID NO: 1279 | MAGE-1 segment 20 | 84 | nts |
| SEQ ID NO: 1280 | Polypeptide encoded by SEQ ID NO: 1279 | 28 | aa |
| SEQ ID NO: 1281 | MAGE-3 segment 1 | 90 | nts |
| SEQ ID NO: 1282 | Polypeptide encoded by SEQ ID NO: 1281 | 30 | aa |
| SEQ ID NO: 1283 | MAGE-3 segment 2 | 90 | nts |
| SEQ ID NO: 1284 | Polypeptide encoded by SEQ ID NO: 1283 | 30 | aa |
| SEQ ID NO: 1285 | MAGE-3 segment 3 | 90 | nts |
| SEQ ID NO: 1286 | Polypeptide encoded by SEQ ID NO: 1285 | 30 | aa |
| SEQ ID NO: 1287 | MAGE-3 segment 4 | 90 | nts |
| SEQ ID NO: 1288 | Polypeptide encoded by SEQ ID NO: 1287 | 30 | aa |
| SEQ ID NO: 1289 | MAGE-3 segment 5 | 90 | nts |
| SEQ ID NO: 1290 | Polypeptide encoded by SEQ ID NO: 1289 | 30 | aa |
| SEQ ID NO: 1291 | MAGE-3 segment 6 | 90 | nts |
| SEQ ID NO: 1292 | Polypeptide encoded by SEQ ID NO: 1291 | 30 | aa |
| SEQ ID NO: 1293 | MAGE-3 segment 7 | 90 | nts |
| SEQ ID NO: 1294 | Polypeptide encoded by SEQ ID NO: 1293 | 30 | aa |
| SEQ ID NO: 1295 | MAGE-3 segment 8 | 90 | nts |
| SEQ ID NO: 1296 | Polypeptide encoded by SEQ ID NO: 1295 | 30 | aa |
| SEQ ID NO: 1297 | MAGE-3 segment 9 | 90 | nts |
| SEQ ID NO: 1298 | Polypeptide encoded by SEQ ID NO: 1297 | 30 | aa |
| SEQ ID NO: 1299 | MAGE-3 segment 10 | 90 | nts |
| SEQ ID NO: 1300 | Polypeptide encoded by SEQ ID NO: 1299 | 30 | aa |
| SEQ ID NO: 1301 | MAGE-3 segment 11 | 90 | nts |
| SEQ ID NO: 1302 | Polypeptide encoded by SEQ ID NO: 1301 | 30 | aa |
| SEQ ID NO: 1303 | MAGE-3 segment 12 | 90 | nts |
| SEQ ID NO: 1304 | Polypeptide encoded by SEQ ID NO: 1303 | 30 | aa |
| SEQ ID NO: 1305 | MAGE-3 segment 13 | 90 | nts |
| SEQ ID NO: 1306 | Polypeptide encoded by SEQ ID NO: 1305 | 30 | aa |

TABLE A-continued

| SEQUENCE ID NUMBER | SEQUENCE | Length | |
|---|---|---|---|
| SEQ ID NO: 1307 | MAGE-3 segment 14 | 90 | nts |
| SEQ ID NO: 1308 | Polypeptide encoded by SEQ ID NO: 1307 | 30 | aa |
| SEQ ID NO: 1309 | MAGE-3 segment 15 | 90 | nts |
| SEQ ID NO: 1310 | Polypeptide encoded by SEQ ID NO: 1309 | 30 | aa |
| SEQ ID NO: 1311 | MAGE-3 segment 16 | 90 | nts |
| SEQ ID NO: 1312 | Polypeptide encoded by SEQ ID NO: 1311 | 30 | aa |
| SEQ ID NO: 1313 | MAGE-3 segment 17 | 90 | nts |
| SEQ ID NO: 1314 | Polypeptide encoded by SEQ ID NO: 1313 | 30 | aa |
| SEQ ID NO: 1315 | MAGE-3 segment 18 | 90 | nts |
| SEQ ID NO: 1316 | Polypeptide encoded by SEQ ID NO: 1315 | 30 | aa |
| SEQ ID NO: 1317 | MAGE-3 segment 19 | 90 | nts |
| SEQ ID NO: 1318 | Polypeptide encoded by SEQ ID NO: 1317 | 30 | aa |
| SEQ ID NO: 1319 | MAGE-3 segment 20 | 90 | nts |
| SEQ ID NO: 1320 | Polypeptide encoded by SEQ ID NO: 1319 | 30 | aa |
| SEQ ID NO: 1321 | MAGE-3 segment 21 | 54 | nts |
| SEQ ID NO: 1322 | Polypeptide encoded by SEQ ID NO: 1321 | 18 | aa |
| SEQ ID NO: 1323 | PRAME segment 1 | 90 | nts |
| SEQ ID NO: 1324 | Polypeptide encoded by SEQ ID NO: 1323 | 30 | aa |
| SEQ ID NO: 1325 | PRAME segment 2 | 90 | nts |
| SEQ ID NO: 1326 | Polypeptide encoded by SEQ ID NO: 1325 | 30 | aa |
| SEQ ID NO: 1327 | PRAME segment 3 | 90 | nts |
| SEQ ID NO: 1328 | Polypeptide encoded by SEQ ID NO: 1327 | 30 | aa |
| SEQ ID NO: 1329 | PRAME segment 4 | 90 | nts |
| SEQ ID NO: 1330 | Polypeptide encoded by SEQ ID NO: 1329 | 30 | aa |
| SEQ ID NO: 1331 | PRAME segment 5 | 90 | nts |
| SEQ ID NO: 1332 | Polypeptide encoded by SEQ ID NO: 1331 | 30 | aa |
| SEQ ID NO: 1333 | PRAME segment 6 | 90 | nts |
| SEQ ID NO: 1334 | Polypeptide encoded by SEQ ID NO: 1333 | 30 | aa |
| SEQ ID NO: 1335 | PRAME segment 7 | 90 | nts |
| SEQ ID NO: 1336 | Polypeptide encoded by SEQ ID NO: 1335 | 30 | aa |
| SEQ ID NO: 1337 | PRAME segment 8 | 90 | nts |
| SEQ ID NO: 1338 | Polypeptide encoded by SEQ ID NO: 1337 | 30 | aa |
| SEQ ID NO: 1339 | PRAME segment 9 | 90 | nts |
| SEQ ID NO: 1340 | Polypeptide encoded by SEQ ID NO: 1339 | 30 | aa |
| SEQ ID NO: 1341 | PRAME segment 10 | 90 | nts |
| SEQ ID NO: 1342 | Polypeptide encoded by SEQ ID NO: 1341 | 30 | aa |
| SEQ ID NO: 1343 | PRAME segment 11 | 90 | nts |
| SEQ ID NO: 1344 | Polypeptide encoded by SEQ ID NO: 1343 | 30 | aa |
| SEQ ID NO: 1345 | PRAME segment 12 | 90 | nts |
| SEQ ID NO: 1346 | Polypeptide encoded by SEQ ID NO: 1345 | 30 | aa |
| SEQ ID NO: 1347 | PRAME segment 13 | 90 | nts |
| SEQ ID NO: 1348 | Polypeptide encoded by SEQ ID NO: 1347 | 30 | aa |
| SEQ ID NO: 1349 | PRAME segment 14 | 90 | nts |
| SEQ ID NO: 1350 | Polypeptide encoded by SEQ ID NO: 1349 | 30 | aa |
| SEQ ID NO: 1351 | PRAME segment 15 | 90 | nts |
| SEQ ID NO: 1352 | Polypeptide encoded by SEQ ID NO: 1351 | 30 | aa |
| SEQ ID NO: 1353 | PRAME segment 16 | 90 | nts |
| SEQ ID NO: 1354 | Polypeptide encoded by SEQ ID NO: 1353 | 30 | aa |
| SEQ ID NO: 1355 | PRAME segment 17 | 90 | nts |
| SEQ ID NO: 1356 | Polypeptide encoded by SEQ ID NO: 1355 | 30 | aa |
| SEQ ID NO: 1357 | PRAME segment 18 | 90 | nts |
| SEQ ID NO: 1358 | Polypeptide encoded by SEQ ID NO: 1357 | 30 | aa |
| SEQ ID NO: 1359 | PRAME segment 19 | 90 | nts |
| SEQ ID NO: 1360 | Polypeptide encoded by SEQ ID NO: 1359 | 30 | aa |
| SEQ ID NO: 1361 | PRAME segment 20 | 90 | nts |
| SEQ ID NO: 1362 | Polypeptide encoded by SEQ ID NO: 1361 | 30 | aa |
| SEQ ID NO: 1363 | PRAME segment 21 | 90 | nts |
| SEQ ID NO: 1364 | Polypeptide encoded by SEQ ID NO: 1363 | 30 | aa |
| SEQ ID NO: 1365 | PRAME segment 22 | 90 | nts |
| SEQ ID NO: 1366 | Polypeptide encoded by SEQ ID NO: 1365 | 30 | aa |
| SEQ ID NO: 1367 | PRAME segment 23 | 90 | nts |
| SEQ ID NO: 1368 | Polypeptide encoded by SEQ ID NO: 1367 | 30 | aa |
| SEQ ID NO: 1369 | PRAME segment 24 | 90 | nts |
| SEQ ID NO: 1370 | Polypeptide encoded by SEQ ID NO: 1369 | 30 | aa |
| SEQ ID NO: 1371 | PRAME segment 25 | 90 | nts |
| SEQ ID NO: 1372 | Polypeptide encoded by SEQ ID NO: 1371 | 30 | aa |
| SEQ ID NO: 1373 | PRAME segment 26 | 90 | nts |
| SEQ ID NO: 1374 | Polypeptide encoded by SEQ ID NO: 1373 | 30 | aa |
| SEQ ID NO: 1375 | PRAME segment 27 | 90 | nts |
| SEQ ID NO: 1376 | Polypeptide encoded by SEQ ID NO: 1375 | 30 | aa |
| SEQ ID NO: 1377 | PRAME segment 28 | 90 | nts |
| SEQ ID NO: 1378 | Polypeptide encoded by SEQ ID NO: 1377 | 30 | aa |
| SEQ ID NO: 1379 | PRAME segment 29 | 90 | nts |
| SEQ ID NO: 1380 | Polypeptide encoded by SEQ ID NO: 1379 | 30 | aa |
| SEQ ID NO: 1381 | PRAME segment 30 | 90 | nts |
| SEQ ID NO: 1382 | Polypeptide encoded by SEQ ID NO: 1381 | 30 | aa |

TABLE A-continued

| SEQUENCE ID NUMBER | SEQUENCE | Length | |
|---|---|---|---|
| SEQ ID NO: 1383 | PRAME segment 31 | 90 | nts |
| SEQ ID NO: 1384 | Polypeptide encoded by SEQ ID NO: 1383 | 30 | aa |
| SEQ ID NO: 1385 | PRAME segment 32 | 90 | nts |
| SEQ ID NO: 1386 | Polypeptide encoded by SEQ ID NO: 1385 | 30 | aa |
| SEQ ID NO: 1387 | PRAME segment 33 | 90 | nts |
| SEQ ID NO: 1388 | Polypeptide encoded by SEQ ID NO: 1387 | 30 | aa |
| SEQ ID NO: 1389 | PRAME segment 34 | 54 | nts |
| SEQ ID NO: 1390 | Polypeptide encoded by SEQ ID NO: 1389 | 18 | aa |
| SEQ ID NO: 1391 | TRP21N2 segment 1 | 90 | nts |
| SEQ ID NO: 1392 | Polypeptide encoded by SEQ ID NO: 1391 | 30 | aa |
| SEQ ID NO: 1393 | TRP21N2 segment 2 | 90 | nts |
| SEQ ID NO: 1394 | Polypeptide encoded by SEQ ID NO: 1393 | 30 | aa |
| SEQ ID NO: 1395 | TRP21N2 segment 3 | 84 | nts |
| SEQ ID NO: 1396 | Polypeptide encoded by SEQ ID NO: 1395 | 28 | aa |
| SEQ ID NO: 1397 | NYNSO1a segment 1 | 90 | nts |
| SEQ ID NO: 1398 | Polypeptide encoded by SEQ ID NO: 1397 | 30 | aa |
| SEQ ID NO: 1399 | NYNSO1a segment 2 | 90 | nts |
| SEQ ID NO: 1400 | Polypeptide encoded by SEQ ID NO: 1399 | 30 | aa |
| SEQ ID NO: 1401 | NYNSO1a segment 3 | 90 | nts |
| SEQ ID NO: 1402 | Polypeptide encoded by SEQ ID NO: 1401 | 30 | aa |
| SEQ ID NO: 1403 | NYNSO1a segment 4 | 90 | nts |
| SEQ ID NO: 1404 | Polypeptide encoded by SEQ ID NO: 1403 | 30 | aa |
| SEQ ID NO: 1405 | NYNSO1a segment 5 | 90 | nts |
| SEQ ID NO: 1406 | Polypeptide encoded by SEQ ID NO: 1405 | 30 | aa |
| SEQ ID NO: 1407 | NYNSO1a segment 6 | 90 | nts |
| SEQ ID NO: 1408 | Polypeptide encoded by SEQ ID NO: 1407 | 30 | aa |
| SEQ ID NO: 1409 | NYNSO1a segment 7 | 90 | nts |
| SEQ ID NO: 1410 | Polypeptide encoded by SEQ ID NO: 1409 | 30 | aa |
| SEQ ID NO: 1411 | NYNSO1a segment 8 | 90 | nts |
| SEQ ID NO: 1412 | Polypeptide encoded by SEQ ID NO: 1411 | 30 | aa |
| SEQ ID NO: 1413 | NYNSO1a segment 9 | 90 | nts |
| SEQ ID NO: 1414 | Polypeptide encoded by SEQ ID NO: 1413 | 30 | aa |
| SEQ ID NO: 1415 | NYNSO1a segment 10 | 90 | nts |
| SEQ ID NO: 1416 | Polypeptide encoded by SEQ ID NO: 1415 | 30 | aa |
| SEQ ID NO: 1417 | NYNSO1a segment 11 | 90 | nts |
| SEQ ID NO: 1418 | Polypeptide encoded by SEQ ID NO: 1417 | 30 | aa |
| SEQ ID NO: 1419 | NYNSO1a segment 12 | 57 | nts |
| SEQ ID NO: 1420 | Polypeptide encoded by SEQ ID NO: 1419 | 19 | aa |
| SEQ ID NO: 1421 | NYNSO1b segment 1 | 90 | nts |
| SEQ ID NO: 1422 | Polypeptide encoded by SEQ ID NO: 1421 | 30 | aa |
| SEQ ID NO: 1423 | NYNSO1b segment 2 | 90 | nts |
| SEQ ID NO: 1424 | Polypeptide encoded by SEQ ID NO: 1423 | 30 | aa |
| SEQ ID NO: 1425 | NYNSO1b segment 3 | 90 | nts |
| SEQ ID NO: 1426 | Polypeptide encoded by SEQ ID NO: 1425 | 30 | aa |
| SEQ ID NO: 1427 | NYNSO1b segment 4 | 51 | nts |
| SEQ ID NO: 1428 | Polypeptide encoded by SEQ ID NO: 1427 | | |
| SEQ ID NO: 1429 | LAGE1 segment 1 | 90 | nts |
| SEQ ID NO: 1430 | Polypeptide encoded by SEQ ID NO: 1429 | 30 | aa |
| SEQ ID NO: 1431 | LAGE1 segment 2 | 90 | nts |
| SEQ ID NO: 1432 | Polypeptide encoded by SEQ ID NO: 1431 | 30 | aa |
| SEQ ID NO: 1433 | LAGE1 segment 3 | 90 | nts |
| SEQ ID NO: 1434 | Polypeptide encoded by SEQ ID NO: 1433 | 30 | aa |
| SEQ ID NO: 1435 | LAGE1 segment 4 | 90 | nts |
| SEQ ID NO: 1436 | Polypeptide encoded by SEQ ID NO: 1435 | 30 | aa |
| SEQ ID NO: 1437 | LAGE1 segment 5 | 90 | nts |
| SEQ ID NO: 1438 | Polypeptide encoded by SEQ ID NO: 1437 | 30 | aa |
| SEQ ID NO: 1439 | LAGE1 segment 6 | 90 | nts |
| SEQ ID NO: 1440 | Polypeptide encoded by SEQ ID NO: 1439 | 30 | aa |
| SEQ ID NO: 1441 | LAGE1 segment 7 | 90 | nts |
| SEQ ID NO: 1442 | Polypeptide encoded by SEQ ID NO: 1441 | 30 | aa |
| SEQ ID NO: 1443 | LAGE1 segment 8 | 90 | nts |
| SEQ ID NO: 1444 | Polypeptide encoded by SEQ ID NO: 1443 | 30 | aa |
| SEQ ID NO: 1445 | LAGE1 segment 9 | 90 | nts |
| SEQ ID NO: 1446 | Polypeptide encoded by SEQ ID NO: 1445 | 30 | aa |
| SEQ ID NO: 1447 | LAGE1 segment 10 | 90 | nts |
| SEQ ID NO: 1448 | Polypeptide encoded by SEQ ID NO: 1447 | 30 | aa |
| SEQ ID NO: 1449 | LAGE1 segment 11 | 90 | nts |
| SEQ ID NO: 1450 | Polypeptide encoded by SEQ ID NO: 1449 | 30 | aa |
| SEQ ID NO: 1451 | LAGE1 segment 12 | 57 | nts |
| SEQ ID NO: 1452 | Polypeptide encoded by SEQ ID NO: 1451 | 19 | aa |
| SEQ ID NO: 1453 | Melanoma cancer specific Savine | 10623 | nts |
| SEQ ID NO: 1454 | Polypeptide encoded by SEQ ID NO: 1453 | 3541 | aa |
| SEQ ID NO: 1455 | FIG. 16 A1S1 99mer | 99 | nts |
| SEQ ID NO: 1456 | FIG. 16 A1S2 100mer | 100 | nts |
| SEQ ID NO: 1457 | FIG. 16 A1S3 100mer | 100 | nts |
| SEQ ID NO: 1458 | FIG. 16 A1S4 100mer | 100 | nts |

TABLE A-continued

| SEQUENCE ID NUMBER | SEQUENCE | Length | |
|---|---|---|---|
| SEQ ID NO: 1459 | FIG. 16 A1S5 100mer | 100 | nts |
| SEQ ID NO: 1460 | FIG. 16 A1S6 99mer | 99 | nts |
| SEQ ID NO: 1461 | FIG. 16 A1S7 97mer | 99 | nts |
| SEQ ID NO: 1462 | FIG. 16 A1S8 100mer | 100 | nts |
| SEQ ID NO: 1463 | FIG. 16 A1S9 100mer | 100 | nts |
| SEQ ID NO: 1464 | FIG. 16 A1S10 75mer | 76 | nts |
| SEQ ID NO: 1465 | FIG. 16 A1F 20mer | 20 | nts |
| SEQ ID NO: 1466 | FIG. 16 A1R 20mer | 20 | nts |
| SEQ ID NO: 1467 | Amino acid sequence of immunostimulatory domain of an invasin protein from Yersinia spp. | 16 | aa |

DETAILED DESCRIPTION OF THE INVENTION

1. Definitions

The articles "a" and "an" are used herein to refer to one or to more than one (i.e., to at least one) of the grammatical object of the article. By way of example, "an element" means one element or more than one element.

As used herein, the term "about" refers to a quantity, level, value, dimension, size, or amount that varies by as much as 30%, preferably by as much as 20%, and more preferably by as much as 10% to a reference quantity, level, value, dimension, size, or amount.

By "antigen-binding molecule" is meant a molecule that has binding affinity for a target antigen. It will be understood that this term extends to immunoglobulins, immunoglobulin fragments and non-immunoglobulin derived protein frameworks that exhibit antigen-binding activity.

The term "clade" as used herein refers to a hypothetical species of an organism and its descendants or a monophyletic group of organisms. Clades carry a definition, based on ancestry, and a diagnosis, based on synapomorphies. It should be noted that diagnoses of clades could change while definitions do not.

Throughout this specification, unless the context requires otherwise, the words "comprise", "comprises" and "comprising" will be understood to imply the inclusion of a stated step or element or group of steps or elements but not the exclusion of any other step or element or group of steps or elements.

By "expression vector" is meant any autonomous genetic element capable of directing the synthesis of a protein encoded by the vector. Such expression vectors are known by practitioners in the art.

As used herein, the term "function" refers to a biological, enzymatic, or therapeutic function.

"Homology" refers to the percentage number of amino acids that are identical or constitute conservative substitutions as defined in Table B infra. Homology may be determined using sequence comparison programs such as GAP (Deveraux et al. 1984, *Nucleic Acids Research* 12, 387-395). In this way, sequences of a similar or substantially different length to those cited herein might be compared by insertion of gaps into the alignment, such gaps being determined, for example, by the comparison algorithm used by GAP.

To enhance an immune response ("immunoenhancement"), as is well-known in the art, means to increase an animal's capacity to respond to foreign or disease-specific antigens (e.g., cancer antigens) i.e., those cells primed to attack such antigens are increased in number, activity, and ability to detect and destroy the those antigens. Strength of immune response is measured by standard tests including: direct measurement of peripheral blood lymphocytes by means known to the art; natural killer cell cytotoxicity assays (see, e.g., Provinciali M. et al (1992, *J. Immunol. Meth*. 155: 19-24), cell proliferation assays (see, e.g., Vollenweider, I. and Groseurth, P. J. (1992, *J. Immunol. Meth*. 149: 133-135), immunoassays of immune cells and subsets (see, e.g. Loeffler, D. A., et al. (1992, Cytom. 13: 169-174); Rivoltini, L.; et al. (1992. *Can. Immunol. Immunother*. 34: 241-251); or skin tests for cell-mediated immunity (see, e.g., Chang, A. E. et al (1993, *Cancer Res*. 53: 1043-1050). Any statistically significant increase in strength of immune response as measured by the foregoing tests is considered "enhanced immune response" "immunoenhancement" or "immunopotentiation" as used herein. Enhanced immune response is also indicated by physical manifestations such as fever and inflammation, as well as healing of systemic and local infections, and reduction of symptoms in disease, i.e., decrease in tumour size, alleviation of symptoms of a disease or condition including, but not restricted to, leprosy, tuberculosis, malaria, naphthous ulcers, herpetic and papillomatous warts, gingivitis, artherosclerosis, the concomitants of AIDS such as Kaposi's sarcoma, bronchial infections, and the like. Such physical manifestations also define "enhanced immune response" "immunoenhancement" or "immunopotentiation" as used herein.

Reference herein to "immuno-interactive" includes reference to any interaction, reaction, or other form of association between molecules and in particular where one of the molecules is, or mimics, a component of the immune system.

By "isolated" is meant material that is substantially or essentially free from components that normally accompany it in its native state.

By "modulating" is meant increasing or decreasing, either directly or indirectly, an immune response against a target antigen of a member selected from the group consisting of a cancer and an organism, preferably a pathogenic organism.

By "natural gene" is meant a gene that naturally encodes a protein.

The term "natural polypeptide" as used herein refers to a polypeptide that exists in nature.

By "obtained from" is meant that a sample such as, for example, a polynucleotide extract or polypeptide extract is isolated from, or derived from, a particular source of the host. For example, the extract can be obtained from a tissue or a biological fluid isolated directly from the host.

The term "oligonucleotide" as used herein refers to a polymer composed of a multiplicity of nucleotide residues (deoxyribonucleotides or ribonucleotides, or related structural variants or synthetic analogues thereof) linked via phosphodiester bonds (or related structural variants or synthetic analogues thereof). Thus, while the term "oligonucleotide" typically refers to a nucleotide polymer in which the nucleotide residues and linkages between them are naturally occurring, it will be understood that the term also includes within its scope various analogues including, but not restricted to, peptide nucleic acids (PNAs), phosphoramidates, phosphorothioates, methyl phosphonates, 2-O-methyl ribonucleic acids, and the like. The exact size of the molecule can vary depending on the particular application. An oligonucleotide is typically rather short in length, generally from about 10 to 30 nucleotide residues, but the term can refer to molecules of any length, although the term "polynucleotide" or "nucleic acid" is typically used for large oligonucleotides.

By "operably linked" is meant that transcriptional and translational regulatory polynucleotides are positioned relative to a polypeptide-encoding polynucleotide in such a manner that the polynucleotide is transcribed and the polypeptide is translated.

The term "parent polypeptide" as used herein typically refers to a polypeptide encoded by a natural gene. However, it is possible that the parent polypeptide corresponds to a protein that is not naturally-occurring but has been engineered using recombinant techniques. In this instance, a polynucleotide encoding the parent polypeptide may comprise different but synonymous codons relative to a natural gene encoding the same polypeptide. Alternatively, the parent polypeptide may not correspond to a natural polypeptide sequence. For example, the parent polypeptide may comprise one or more consensus sequences common to a plurality of polypeptides.

The term "patient" refers to patients of human or other mammal and includes any individual it is desired to examine or treat using the methods of the invention. However, it will be understood that "patient" does not imply that symptoms are present. Suitable mammals that fall within the scope of the invention include, but are not restricted to, primates, livestock animals (e.g., sheep, cows, horses, donkeys, pigs), laboratory test animals (e.g., rabbits, mice, rats, guinea pigs, hamsters), companion animals (e.g., cats, dogs) and captive wild animals (e.g., foxes, deer, dingoes).

By "pharmaceutically-acceptable carrier" is meant a solid or liquid filler, diluent or encapsulating substance that can be safely used in topical or systemic administration to a mammal.

"Polypeptide", "peptide" and "protein" are used interchangeably herein to refer to a polymer of amino acid residues and to variants and synthetic analogues of the same. Thus, these terms apply to amino acid polymers in which one or more amino acid residues is a synthetic non-naturally occurring amino acid, such as a chemical analogue of a corresponding naturally occurring amino acid, as well as to naturally-occurring amino acid polymers.

The term "polynucleotide" or "nucleic acid" as used herein designates mRNA, RNA, cRNA, cDNA or DNA. The term typically refers to oligonucleotides greater than 30 nucleotide residues in length.

By "primer" is meant an oligonucleotide which, when paired with a strand of DNA, is capable of initiating the synthesis of a primer extension product in the presence of a suitable polymerising agent. The primer is preferably single-stranded for maximum efficiency in amplification but can alternatively be double-stranded. A primer must be sufficiently long to prime the synthesis of extension products in the presence of the polymerisation agent. The length of the primer depends on many factors, including application, temperature to be employed, template reaction conditions, other reagents, and source of primers. For example, depending on the complexity of the target sequence, the oligonucleotide primer typically contains 15 to 35 or more nucleotide residues, although it can contain fewer nucleotide residues. Primers can be large polynucleotides, such as from about 35 nucleotides to several kilobases or more. Primers can be selected to be "substantially complementary" to the sequence on the template to which it is designed to hybridise and serve as a site for the initiation of synthesis. By "substantially complementary", it is meant that the primer is sufficiently complementary to hybridise with a target polynucleotide. Preferably, the primer contains no mismatches with the template to which it is designed to hybridise but this is not essential. For example, non-complementary nucleotide residues can be attached to the 5' end of the primer, with the remainder of the primer sequence being complementary to the template. Alternatively, non-complementary nucleotide residues or a stretch of non-complementary nucleotide residues can be interspersed into a primer, provided that the primer sequence has sufficient complementarity with the sequence of the template to hybridise therewith and thereby form a template for synthesis of the extension product of the primer.

"Probe" refers to a molecule that binds to a specific sequence or sub-sequence or other moiety of another molecule. Unless otherwise indicated, the term "probe" typically refers to a polynucleotide probe that binds to another polynucleotide, often called the "target polynucleotide", through complementary base pairing. Probes can bind target polynucleotides lacking complete sequence complementarity with the probe, depending on the stringency of the hybridisation conditions. Probes can be labelled directly or indirectly.

By "recombinant polypeptide" is meant a polypeptide made using recombinant techniques, i.e., through the expression of a recombinant or synthetic polynucleotide.

Terms used to describe sequence relationships between two or more polynucleotides or polypeptides include "reference sequence", "comparison window", "sequence identity", "percentage of sequence identity" and "substantial identity". A "reference sequence" is at least 12 but frequently 15 to 18 and often at least 25 monomer units, inclusive of nucleotides and amino acid residues, in length. Because two polynucleotides may each comprise (1) a sequence (i.e., only a portion of the complete polynucleotide sequence) that is similar between the two polynucleotides, and (2) a sequence that is divergent between the two polynucleotides, sequence comparisons between two (or more) polynucleotides are typically performed by comparing sequences of the two polynucleotides over a "comparison window" to identify and compare local regions of sequence similarity. A "comparison window" refers to a conceptual segment of at least 50 contiguous positions, usually about 50 to about 100, more usually about 100 to about 150 in which a sequence is compared to a reference sequence of the same number of contiguous positions after the two sequences are optimally aligned. The comparison window may comprise additions or deletions (i.e., gaps) of about 20% or less as compared to the reference sequence (which does not comprise additions or deletions) for optimal alignment of the two sequences. Optimal alignment of sequences for aligning a comparison window may be conducted by computerised implementations of algorithms (GAP, BESTFIT, FASTA, and TFASTA in the Wisconsin Genetics Software Package Release 7.0, Genetics Computer Group, 575 Science Drive Madison, Wis., USA) or by inspection and the best alignment (i.e., resulting in the highest percentage homology over the comparison window) generated by any of the various methods selected. Reference also may be made to the BLAST family of programs as for example disclosed by Altschul et al., 1997, *Nucl. Acids Res.* 25:3389. A detailed discussion of sequence analysis can be found in Unit 19.3 of Ausubel et al., "Current Protocols in Molecular Biology", John Wiley & Sons Inc, 1994-1998, Chapter 15.

The term "sequence identity" as used herein refers to the extent that sequences are identical on a nucleotide-by-nucleotide basis or an amino acid-by-amino acid basis over a window of comparison. Thus, a "percentage of sequence identity" is calculated by comparing two optimally aligned sequences over the window of comparison, determining the number of positions at which the identical nucleic acid base (e.g., A, T, C, G, I) or the identical amino acid residue (e.g. Ala, Pro, Ser, Thr, Gly, Val, Leu, Ile, Phe, Tyr, Trp, Lys, Arg, His, Asp, Glu, Asn, Gln, Cys and Met) occurs in both sequences to yield the number of matched positions, dividing the number of matched positions by the total number of positions in the window of comparison (i.e., the window size), and multiplying the result by 100 to yield the percentage of sequence identity. For the purposes of the present invention, "sequence identity" will be understood to mean the "match percentage" calculated by the DNASIS computer program (Version 2.5 for windows; available from Hitachi Software engineering Co., Ltd., South San Francisco, Calif., USA) using standard defaults as used in the reference manual accompanying the software.

The term "synthetic polynucleotide" as used herein refers to a polynucleotide formed in vitro by the manipulation of a polynucleotide into a form not normally found in nature. For example, the synthetic polynucleotide can be in the form of an expression vector. Generally, such expression vectors include transcriptional and translational regulatory polynucleotide operably linked to the polynucleotide.

The term "synonymous codon" as used herein refers to a codon having a different nucleotide sequence than another codon but encoding the same amino acid as that other codon.

By "translational efficiency" is meant the efficiency of a cell's protein synthesis machinery to incorporate the amino acid encoded by a codon into a nascent polypeptide chain. This efficiency can be evidenced, for example, by the rate at which the cell is able to synthesise the polypeptide from an RNA template comprising the codon, or by the amount of the polypeptide synthesised from such a template.

By "vector" is meant a polynucleotide molecule, preferably a DNA molecule derived, for example, from a plasmid, bacteriophage, yeast or virus, into which a polynucleotide can be inserted or cloned. A vector preferably contains one or more unique restriction sites and can be capable of autonomous replication in a defined host cell including a target cell or tissue or a progenitor cell or tissue thereof, or be integrable with the genome of the defined host such that the cloned sequence is reproducible. Accordingly, the vector can be an autonomously replicating vector, i.e., a vector that exists as an extrachromosomal entity, the replication of which is independent of chromosomal replication, e.g., a linear or closed circular plasmid, an extrachromosomal element, a minichromosome, or an artificial chromosome. The vector can contain any means for assuring self-replication. Alternatively, the vector can be one which, when introduced into the host cell, is integrated into the genome and replicated together with the chromosome(s) into which it has been integrated. A vector system can comprise a single vector or plasmid, two or more vectors or plasmids, which together contain the total DNA to be introduced into the genome of the host cell, or a transposon. The choice of the vector will typically depend on the compatibility of the vector with the host cell into which the vector is to be introduced. In the present case, the vector is preferably a viral or viral-derived vector, which is operably functional in animal and preferably mammalian cells. Such vector may be derived from a poxvirus, an adenovirus or yeast. The vector can also include a selection marker such as an antibiotic resistance gene that can be used for selection of suitable transformants. Examples of such resistance genes are known to those of skill in the art and include the nptII gene that confers resistance to the antibiotics kanamycin and G418 (Geneticin®) and the hph gene which confers resistance to the antibiotic hygromycin B.

2. Synthetic Polypeptides

The inventors have surprisingly discovered that the structure of a parent polypeptide can be disrupted sufficiently to impede, abrogate or otherwise alter at least one function of the parent polypeptide, while simultaneously minimising the destruction of potentially useful epitopes that are present in the parent polypeptide, by fusing, coupling or otherwise linking together different segments of the parent polypeptide in a different relationship relative to their linkage in the parent polypeptide. As a result of this change in relationship, the sequence of the linked segments in the resulting synthetic polypeptide is different to a sequence contained within the parent polypeptide. The synthetic polypeptides of the invention are useful as immunopotentiating agents, and are referred to elsewhere in the specification as scrambled antigen vaccines, super attenuated vaccines or "Savines".

Thus, the invention broadly resides in a synthetic polypeptide comprising a plurality of different segments of at least one parent polypeptide, wherein said segments are linked together in a different relationship relative to their linkage in the at least one parent polypeptide.

It is preferable but not essential that the segments in said synthetic polypeptide are linked sequentially in a different order or arrangement relative to that of corresponding segments in said at least one parent polypeptide. For example, in the case of a parent polypeptide that comprises four contiguous or overlapping segments A-B-C-D, these segments may be linked in 23 other possible orders to form a synthetic polypeptide. These orders may be selected from the group consisting of: A-B-D-C, A-C-B-D, A-C-D-B, A-D-B-C, A-D-C-B, B-A-C-D, B-A-D-C, B-C-A-D, B-C-D-A, B-D-A-C, B-D-C-A, C-A-B-D, C-A-D-B, C-B-A-D, C-B-D-A, C-D-A-B, C-D-B-A, D-A-B-C, D-A-C-B, D-B-A-C, D-B-C-A, D-C-A-B, and D-C-B-A. Although the rearrangement of the segments is preferably random, it is especially preferable to exclude or otherwise minimize rearrangements that result in complete or partial reassembly of the parent sequence (e.g., ADBC, BACD, DABC). It will be appreciated, however, that the probability of such complete or partial reassembly diminishes as the number of segments for rearrangement increases.

The order of the segments is suitably shuffled, reordered or otherwise rearranged relative to the order in which they exist in the parent polypeptide so that the structure of the polypeptide is disrupted sufficiently to impede, abrogate or otherwise alter at least one function associated with the parent polypeptide. Preferably, the segments of the parent polypeptide are randomly rearranged in the synthetic polypeptide.

The parent polypeptide is suitably a polypeptide that is associated with a disease or condition. For example, the parent polypeptide may be a polypeptide expressed by a pathogenic organism or a cancer. Alternatively, the parent polypeptide can be a self peptide related to an autoimmune disease including, but are not limited to, diseases such as diabetes (e.g., juvenile diabetes), multiple sclerosis, rheumatoid arthritis, myasthenia gravis, atopic dermatitis, and psoriasis and ankylosing spondylitis. Accordingly, the synthetic molecules of the present invention may also have utility for the induction of tolerance in a subject afflicted with an autoimmune disease or condition or with an allergy or other condition to which tolerance is desired. For example tolerance may be induced by contacting an immature dendritic cell of the individual to be treated with a synthetic polypeptide of the invention or by expressing in an immature dendritic cell a synthetic polynucleotide of the invention. Tolerance may also be induced against antigens causing allergic responses (e.g., asthma, hay fever). In this case, the parent polypeptide is suitably an allergenic protein including, but not restricted to, house-dust-mite allergenic proteins as for example described by Thomas and Smith (1998, *Allergy*, 53(9): 821-832).

The pathogenic organism includes, but is not restricted to, yeast, a virus, a bacterium, and a parasite. Any natural host of the pathogenic organism is contemplated by the present invention and includes, but is not limited to, mammals, avians and fish. In a preferred embodiment, the pathogenic organism is a virus, which may be an RNA virus or a DNA virus. Preferably, the RNA virus is Human Immunodeficiency Virus (HIV), Poliovirus, and Influenza virus, Rous sarcoma virus, or a Flavivirus such as Japanese encephalitis virus. In a preferred embodiment, the RNA virus is a Hepatitis virus including, but not limited to, Hepatitis strains A, B and C. Suitably, the DNA virus is a Herpesvirus including, but not limited to, Herpes simplex virus, Epstein-Barr virus, Cytomegalovirus and Parvovirus. In a preferred embodiment, the virus is HIV and the parent polypeptide is suitably selected from env, gag, pol, vif, vpr, tat, rev, vpu and nef, or combination thereof. In an alternate preferred embodiment, the virus is Hepatitis C1a virus and the parent polypeptide is the Hepatitis C1a virus polyprotein.

In another embodiment, the pathogenic organism is a bacterium, which includes, but is not restricted to, *Neisseria* species, *Meningococcal* species, *Haemophilus* species *Salmonella* species, *Streptococcal* species, *Legionella* species and *Mycobacterium* species.

In yet another embodiment, the pathogenic organism is a parasite, which includes, but is not restricted to, *Plasmodium* species, *Schistosoma* species, *Leishmania* species, *Trypanosoma* species, *Toxoplasma* species and *Giardia* species.

Any cancer or tumour is contemplated by the present invention. For example, the cancer or tumour includes, but is not restricted to, melanoma, lung cancer, breast cancer, cervical cancer, prostate cancer, colon cancer, pancreatic cancer, stomach cancer, bladder cancer, kidney cancer, post transplant lymphoproliferative disease (PTLD), Hodgkin's Lymphoma and the like. Preferably, the cancer or tumour relates to melanoma. In a preferred embodiment of this type, the parent polypeptide is a melanocyte differentiation antigen which is suitably selected from gp100, MART, TRP-1, Tyros, TRP2, MC1R, MUC1F, MUC1R or a combination thereof In an alternate preferred embodiment of this type, the parent polypeptide is a melanoma-specific antigen which is suitably selected from BAGE, GAGE-1, gp100In4, MAGE-1, MAGE-3, PRAME, TRP2IN2, NYNSO1a, NYNSO1b, LAGE1 or a combination thereof.

In a preferred embodiment, the segments are selected on the basis of size. A segment according to the invention may be of any suitable size that can be utilised to elicit an immune response against an antigen encoded by the parent polypeptide. A number of factors can influence the choice of segment size. For example, the size of a segment should be preferably chosen such that it includes, or corresponds to the size of, T cell epitopes and their processing requirement. Practitioners in the art will recognise that class I-restricted T cell epitopes can be between 8 and 10 amino acids in length and if placed next to unnatural flanking residues, such epitopes can generally require 2 to 3 natural flanking amino acids to ensure that they are efficiently processed and presented. Class II-restricted T cell epitopes can range between 12 and 25 amino acids in length and may not require natural flanking residues for efficient proteolytic processing although it is believed that natural flanking residues may play a role. Another important feature of class II-restricted epitopes is that they generally contain a core of 9-10 amino acids in the middle which bind specifically to class II MHC molecules with flanking sequences either side of this core stabilising binding by associating with conserved structures on either side of class II MHC antigens in a sequence independent manner (Brown et al., 1993). Thus the functional region of class II-restricted epitopes is typically less than 15 amino acids long. The size of linear B cell epitopes and the factors effecting their processing, like class II-restricted epitopes, are quite variable although such epitopes are frequently smaller in size than 15 amino acids. From the foregoing, it is preferable, but not essential, that the size of the segment is at least 4 amino acids, preferably at least 7 amino acids, snore preferably at least 12 amino acids, more preferably at least 20 amino acids and more preferably at least 30 amino acids. Suitably, the size of the segment is less than 2000 amino acids, more preferably less than 1000 amino acids, more preferably less than 500 amino acids, more preferably less than 200 amino acids, more preferably less than 100 amino acids, more preferably less than 80 amino acids and even more preferably less than 60 amino acids and still even more preferably less than 40 amino acids. In this regard, it is preferable that the size of the segments is as small as possible so that the synthetic polypeptide adopts a functionally different structure relative to the structure of the parent polypeptide. It is also preferable that the size of the segments is large enough to minimise loss of T cell epitopes. In an especially preferred embodiment, the size of the segment is about 30 amino acids.

An optional spacer may be utilised to space adjacent segments relative to each other. Accordingly, an optional spacer may be interposed between some or all of the segments. The spacer suitably alters proteolytic processing and/or presentation of adjacent segment(s). In a preferred embodiment of this type, the spacer promotes or otherwise enhances proteolytic processing and/or presentation of adjacent segment(s). Preferably, the spacer comprises at least one amino acid. The at least one amino acid is suitably a neutral amino acid. The neutral amino acid is preferably alanine. Alternatively, the at least one amino acid is cysteine.

In a preferred embodiment, segments are selected such that they have partial sequence identity or homology with one or more other segments. Suitably, at one or both ends of a respective segment there is comprised at least 4 contiguous amino acids, preferably at least 7 contiguous amino acids, more preferably at least 10 contiguous amino acids, more preferably at least 15 contiguous amino acids and even more preferably at least 20 contiguous amino acids that are identical to, or homologous with, an amino acid sequence contained within one or more other of said segments. Preferably, at the or each end of a respective segment there is comprised less than 500 contiguous amino acids, more preferably less than 200 contiguous amino acids, more preferably less than 100 contiguous amino acids, more preferably less than 50 contiguous amino acids, more preferably less than 40 contiguous amino acids, and even more preferably less than 30 contiguous amino acids that are identical to, or homologous with, an amino acid sequence contained within one or more other of said segments. Such sequence overlap (also referred to elsewhere in the specification as "overlapping fragments" or "overlapping segments") is preferable to ensure potential epitopes at segment boundaries are not lost and to ensure that epitopes at or near segment boundaries are processed efficiently if placed beside or near amino acids that inhibit processing. Preferably, the segment size is about twice the size of the overlap.

In a preferred embodiment, when segments have partial sequence homology therebetween, the homologous sequences suitably comprise conserved and/or non-conserved amino acid differences. Exemplary conservative substitutions are listed in the following table.

TABLE B

| Original Residue | Exemplary Substitutions |
| --- | --- |
| Ala | Ser |
| Arg | Lys |
| Asn | Gln, His |
| Asp | Glu |
| Cys | Ser |
| Gln | Asn |
| Glu | Asp |
| Gly | Pro |
| His | Asn, Gln |
| Ile | Leu, Val |
| Leu | Ile, Val |
| Lys | Arg, Gln, Glu |
| Met | Leu, Ile, |
| Phe | Met, Leu, Tyr |
| Ser | Thr |
| Thr | Ser |
| Trp | Tyr |
| Tyr | Trp, Phe |
| Val | Ile, Leu |

Conserved or non-conserved differences may correspond to polymorphisms in corresponding parent polypeptides. Polymorphic polypeptides are expressed by various pathogenic organisms and cancers. For example, the polymorphic polypeptides may be expressed by different viral strains or clades or by cancers in different individuals.

Sequence overlap between respective segments is preferable to minimise destruction of any epitope sequences that may result from any shuffling or rearrangement of the segments relative to their existing order in the parent polypeptide. If overlapping segments as described above are employed to form a synthetic polypeptide, it may not be necessary to change the order in which those segments are linked together relative to the order in which corresponding segments are normally present in the parent polypeptide. In this regard, such overlapping segments when linked together in the synthetic polypeptide can adopt a different structure relative to the structure of the parent polypeptide, wherein the different structure does not provide for one or more functions associated with the parent polypeptide. For example, in the case of four segments A-B-C-D each spanning 30 contiguous amino acids of the parent polypeptide and having a 10-amino acid overlapping sequence with one or more adjacent segments, the synthetic polypeptide will have duplicated 10-amino acid sequences bridging segments A-B, B-C and C-D. The presence of these duplicated sequences may be sufficient to render a different structure and to abrogate or alter function relative to the parent polypeptide.

In a preferred embodiment, segment size is about 30 amino acids and sequence overlap at one or both ends of a respective segment is about 15 amino acids. However, it will be understood that other suitable segment sizes and sequence overlap sizes are contemplated by the present invention, which can be readily ascertained by persons of skill in the art.

It is preferable but not necessary to utilise all the segments of the parent polypeptide in the construction of the synthetic polypeptide. Suitably, at least 30%, preferably at least 40%, more preferably at least 50%, even more preferably at least 60%, even more preferably at least 70%, even more preferably at least 80% and still even more preferably at least 90% of the parent polypeptide sequence is used in the construction of the synthetic polypeptide. However, it will be understood that the more sequence information from a parent polypeptide that is utilised to construct the synthetic polypeptide, the greater the population coverage will be of the synthetic polypeptide as an immunogen. Preferably, no sequence information from the parent polypeptide is excluded (e.g., because of an apparent lack of immunological epitopes).

Persons of skill in the art will appreciate that when preparing a synthetic polypeptide against a pathogenic organism (e.g., a virus) or a cancer, it may be preferable to use sequence information from a plurality of different polypeptides expressed by the organism or the cancer. Accordingly, in a preferred embodiment, segments from a plurality of different polypeptides are linked together to form a synthetic polypeptide according to the invention. It is preferable in this respect to utilise as many parent polypeptides as possible from, or in relation to, a particular source in the construction of the synthetic polypeptide. The source of parent polypeptides includes, but is not limited to, a pathogenic organism and a cancer. Suitably, at least about 30%, preferably at least 40%, more preferably at least 50%, even more preferably at least 60%, even more preferably at least 70%, even more preferably at least 80% and still even more preferably at least 90% of the parent polypeptides expressed by the source is used in the construction of the synthetic polypeptide. Preferably, parent polypeptides from a virus include, but are not restricted to, latent polypeptides, regulatory polypeptides or polypeptides expressed early during their replication cycle. Suitably, parent polypeptides from a parasite or bacterium include, but are not restricted to, secretory polypeptides and polypeptides expressed on the surface of the parasite or bacteria. It is preferred that parent polypeptides from a cancer or tumour are cancer specific polypeptides.

Suitably, hypervariable sequences within the parent polypeptide are excluded from the construction of the synthetic polypeptide.

The synthetic polypeptides of the inventions may be prepared by any suitable procedure known to those of skill in the art. For example, the polypeptide may be synthesised using solution synthesis or solid phase synthesis as described, for example, in Chapter 9 of Atherton and Shephard (1989, Solid Phase Peptide Synthesis: A Practical Approach. IRL Press, Oxford) and in Roberge et at (1995, *Science* 269: 202). Syntheses may employ, for example, either t-butyloxycarbonyl (t-Boc) or 9-fluorenylmethyloxycarbonyl (Fmoc) chemistries (see Chapter 9.1, of Coligan et al., CURRENT PROTOCOLS IN PROTEIN SCIENCE, John Wiley & Sons, Inc. 1995-1997; Stewart and Young, 1984, Solid Phase Peptide Synthesis, 2nd ed. Pierce Chemical Co., Rockford, Ill.; and Atherton and Shephard, supra).

Alternatively, the polypeptides may be prepared by a procedure including the steps of:

(a) preparing a synthetic construct including a synthetic polynucleotide encoding a synthetic polypeptide wherein said synthetic polynucleotide is operably linked to a regulatory polynucleotide, wherein said synthetic polypeptide comprises a plurality of different segments of a parent polypeptide, wherein said segments are linked together in a different relationship relative to their linkage in the parent polypeptide;

(b) introducing the synthetic construct into a suitable host cell;

(c) culturing the host cell to express the synthetic polypeptide from said synthetic construct; and
(d) isolating the synthetic polypeptide.

The synthetic construct is preferably in the form of an expression vector. For example, the expression vector can be a self-replicating extra-chromosomal vector such as a plasmid, or a vector that integrates into a host genome. Typically, the regulatory polynucleotide may include, but is not limited to, promoter sequences, leader or signal sequences, ribosomal binding sites, transcriptional start and stop sequences, translational start and termination sequences, and enhancer or activator sequences. Constitutive or inducible promoters as known in the art are contemplated by the invention. The promoters may be either naturally occurring promoters, or hybrid promoters that combine elements of more than one promoter. The regulatory polynucleotide will generally be appropriate for the host cell used for expression. Numerous types of appropriate expression vectors and suitable regulatory polynucleotides are known in the art for a variety of host cells.

In a preferred embodiment, the expression vector contains a selectable marker gene to allow the selection of transformed host cells. Selection genes are well known in the art and will vary with the host cell used.

The expression vector may also include a fusion partner (typically provided by the expression vector) so that the synthetic polypeptide of the invention is expressed as a fusion polypeptide with said fusion partner. The main advantage of fusion partners is that they assist identification and/or purification of said fusion polypeptide. In order to express said fusion polypeptide, it is necessary to ligate a polynucleotide according to the invention into the expression vector so that the translational reading frames of the fusion partner and the polynucleotide coincide.

Well known examples of fusion partners include, but are not limited to, glutathione-S-transferase (GST), Fc portion of human IgG, maltose binding protein (MBP) and hexahistidine ($HIS_6$), which are particularly useful for isolation of the fusion polypeptide by affinity chromatography. For the purposes of fusion polypeptide purification by affinity chromatography, relevant matrices for affinity chromatography are glutathione-, amylose-, and nickel- or cobalt-conjugated resins respectively. Many such matrices are available in "kit" form, such as the QIAexpress™ system (Qiagen) useful with ($HIS_6$) fusion partners and the Pharmacia GST purification system. In a preferred embodiment, the recombinant polynucleotide is expressed in the commercial vector pFLAG™.

Another fusion partner well known in the art is green fluorescent protein (GFP). This fusion partner serves as a fluorescent "tag" which allows the fusion polypeptide of the invention to be identified by fluorescence microscopy or by flow cytometry. The GFP tag is useful when assessing subcellular localisation of a fusion polypeptide of the invention, or for isolating cells which express a fusion polypeptide of the invention. Flow cytometric methods such as fluorescence activated cell sorting (FACS) are particularly useful in this latter application. Preferably, the fusion partners also have protease cleavage sites, such as for Factor $X_a$, Thrombin and inteins (protein introns), which allow the relevant protease to partially digest the fusion polypeptide of the invention and thereby liberate the recombinant polypeptide of the invention therefrom. The liberated polypeptide can then be isolated from the fusion partner by subsequent chromatographic separation. Fusion partners according to the invention also include within their scope "epitope tags", which are usually short peptide sequences for which a specific antibody is available. Well known examples of epitope tags for which specific monoclonal antibodies are readily available include c-Myc, influenza virus, haemagglutinin and FLAG tags. Alternatively, a fusion partner may be provided to promote other forms of immunity. For example, the fusion partner may be an antigen-binding molecule that is immuno-interactive with a conformational epitope on a target antigen or to a post-translational modification of a target antigen (e.g., an antigen-binding molecule that is immuno-interactive with a glycosylated target antigen).

The step of introducing the synthetic construct into the host cell may be effected by any suitable method including transfection, and transformation, the choice of which will be dependent on the host cell employed. Such methods are well known to those of skill in the art.

Synthetic polypeptides of the invention may be produced by culturing a host cell transformed with the synthetic construct. The conditions appropriate for protein expression will vary with the choice of expression vector and the host cell. This is easily ascertained by one skilled in the art through routine experimentation.

Suitable host cells for expression may be prokaryotic or eukaryotic. One preferred host cell for expression of a polypeptide according to the invention is a bacterium. The bacterium used may be *Escherichia coli*. Alternatively, the host cell may be an insect cell such as, for example, SF9 cells that may be utilised with a baculovirus expression system.

The synthetic polypeptide may be conveniently prepared by a person skilled in the art using standard protocols as for example described in Sambrook, et al., MOLECULAR CLONING. A LABORATORY MANUAL (Cold Spring Harbor Press, 1989), in particular Sections 16 and 17; Ausubel et al., CURRENT PROTOCOLS IN MOLECULAR BIOLOGY (John Wiley & Sons, Inc. 1994-1998), in particular Chapters 10 and 16; and Coligan et al., CURRENT PROTOCOLS IN PROTEIN SCIENCE (John Wiley & Sons, Inc. 1995-1997), in particular Chapters 1, 5 and 6.

The amino acids of the synthetic polypeptide can be any non-naturally occurring or any naturally occurring amino acid. Examples of unnatural amino acids and derivatives during peptide synthesis include but are not limited to, use of 4-amino butyric acid, 6-aminohexanoic acid, 4-amino-3-hydroxy-5-phenylpentanoic acid, 4-amino-3-hydroxy-6-methylheptanoic acid, t-butylglycine, norleucine, norvaline, phenylglycine, ornithine, sarcosine, 2-thienyl alanine and/or D-isomers of amino acids. A list of unnatural amino acids contemplated by the present invention is shown in TABLE C.

TABLE C

| Non-conventional Amino Acid | Non-conventional Amino Acid |
| --- | --- |
| α-aminobutyric acid | L-N-methylalanine |
| α-amino-α-methylbutyrate | L-N-methylarginine |
| aminocyclopropane-carboxylate | L-N-methylasparagine |
| aminoisobutyric acid | L-N-methylaspartic acid |
| aminonorbornyl-carboxylate | L-N-methylcysteine |
| cyclohexylalanine | L-N-methylglutamine |
| cyclopentylalanine | L-N-methylglutamic acid |
| L-N-methylisoleucine | L-N-methylhistidine |
| D-alanine | L-N-methylleucine |
| D-arginine | L-N-methyllysine |
| D-aspartic acid | L-N-methylmethionine |
| D-cysteine | L-N-methylnorleucine |
| D-glutamate | L-N-methylnorvaline |
| D-glutamic acid | L-N-methylornithine |
| D-histidine | L-N-methylphenylalanine |
| D-isoleucine | L-N-methylproline |
| D-leucine | L-N-methlylserine |
| D-lysine | L-N-methylthreonine |
| D-methionine | L-N-methyltryptophan |

TABLE C-continued

| Non-conventional Amino Acid | Non-conventional Amino Acid |
| --- | --- |
| D-ornithine | L-N-methyltyrosine |
| D-phenylalanine | L-N-methylvaline |
| D-proline | L-N-methylethylglycine |
| D-serine | L-N-methyl-t-butylglycine |
| D-threonine | L-norleucine |
| D-tryptophan | L-norvaline |
| D-tyrosine | α-methyl-aminoisobutyrate |
| D-valin | α-methyl-γ-aminobutyrate |
| D-α-methylalanine | α-methylcyclohexylalanine |
| D-α-methylarginine | α-methylcylcopentylalanine |
| D-α-methylasparagine | α-methyl-α-napthylalanine |
| D-α-methylaspartate | α-methylpenicillamine |
| D-α-methylcysteine | N-(4-aminobutyl)glycine |
| D-α-methylglutamine | N-(2-aminoethyl)glycine |
| D-α-methylhistidine | N-(3-aminopropyl)glycine |
| D-α-methylisoleucine | N-amino-α-methylbutyrate |
| D-α-methylleucine | α-napthylalanine |
| D-α-methyllysine | N-benzylglycine |
| D-α-methylmethionine | N-(2-carbamylediyl)glycine |
| D-α-methylornithiine | N-(carbamylmethyl)glycine |
| D-α-methylphenylalanine | N-(2-carboxyethyl)glycine |
| D-α-methylproline | N-(carboxymethyl)glycine |
| D-α-methylserine | N-cyclobutylglycine |
| D-α-methylthreonine | N-cycloheptylglycine |
| D-α-methyltryptophan | N-cyclohexylglycine |
| D-α-methyltyrosine | N-cyclodecylglycine |
| L-α-methylleucine | L-α-methyllysine |
| L-α-methylmethionine | L-α-methylnorleucine |
| L-α-methylnorvatine | L-α-methylornithine |
| L-α-methylphenylalanine | L-α-methylproline |
| L-α-methylserine | L-α-methylthreonine |
| L-α-methyltryptophan | L-α-methyltyrosine |
| L-α-methylvaline | L-α-methylhomophenylalanine |
| N-(N-(2,2-diphenylethyl carbamylmethyl)glycine | N-(N-(3,3-diphenylpropyl carbamylmethyl)glycine |
| 1-carboxy-1-(2,2-diphenyl-ethyl amino)cyclopropane | |

The invention also contemplates modifying the synthetic polypeptides of the invention using ordinary molecular biological techniques so as to alter their resistance to proteolytic degradation or to optimise solubility properties or to render them more suitable as an immunogenic agent.

3. Preparation of Synthetic Polynucleotides of the Invention

The invention contemplates synthetic polynucleotides encoding the synthetic polypeptides as for example described in Section 2 supra. Polynucleotides encoding segments of a parent polypeptide can be produced by any suitable technique. For example, such polynucleotides can be synthesised de novo using readily available machinery. Sequential synthesis of DNA is described, for example, in U.S. Pat. No 4,293,652. Instead of de novo synthesis, recombinant techniques may be employed including use of restriction endonucleases to cleave a polynucleotide encoding at least a segment of the parent polypeptide and use of ligases to ligate together in frame a plurality of cleaved polynucleotides encoding different segments of the parent polypeptide. Suitable recombinant techniques are described for example in the relevant sections of Ausubel, et al. (supra) and of Sambrook, et al., (supra) which are incorporated herein by reference. Preferably, the synthetic polynucleotide is constructed using splicing by overlapping extension (SOEing) as for example described by Horton et al. (1990, *Biotechniques* 8(5): 528-535; 1995, *Mol Biotechnol*. 3(2): 93-99; and 1997, *Methods Mol Biol*. 67: 141-149). However, it should be noted that the present invention is not dependent on, and not directed to, any one particular technique for constructing the synthetic construct.

Various modifications to the synthetic polynucleotides may be introduced as a means of increasing intracellular stability and half-life. Possible modifications include but are not limited to the addition of flanking sequences of ribo- or deoxy-nucleotides to the 5' and/or 3' ends of the molecule or the use of phosphorothioate or 2' O-methyl rather than phosphodiesterase linkages within the oligodeoxyribonucleotide backbone.

The invention therefore contemplates a method of producing a synthetic polynucleotide as broadly described above, comprising linking together in the same reading frame at least two nucleic acid sequences encoding different segments of a parent polypeptide to form a synthetic polynucleotide, which encodes a synthetic polypeptide according to the invention. Suitably, nucleic acid sequences encoding at least 10 segments, preferably at least 20 segments, more preferably at least 40 segments and more preferably at least 100 segments of a parent polypeptide are employed to produce the synthetic polynucleotide.

Preferably, the method further comprises selecting segments of the parent polypeptide, reverse translating the selected segments and preparing nucleic acid sequences encoding the selected segments. It is preferred that the method further comprises randomly linking the nucleic acid sequences together to form the synthetic polynucleotide. The nucleic acid sequences may be oligonucleotides or polynucleotides.

Suitably, segments are selected on the basis of size. Additionally, or in the alternative, segments are selected such that they have partial sequence identity or homology (i.e., sequence overlap) with one or more other segments. A number of factors can influence segment size and sequence overlap as mentioned above. In the case of sequence overlap, large amounts of duplicated nucleic acid sequences can sometimes result in sections of nucleic acid being lost during nucleic acid amplification (e.g., polymerase chain reaction, PCR) of such sequences, recombinant plasmid propagation in a bacterial host or during amplification of recombinant viruses containing such sequences. Accordingly, in a preferred embodiment, nucleic acid sequences encoding segments having sequence identity or homology with one or more other encoded segments are not linked together in an arrangement in which the identical or homologous sequences are contiguous. Also, it is preferable that different codons are used to encode a specific amino acid in a duplicated region. In this context, an amino acid of a parent polypeptide sequence is preferably reverse translated to provide a codon which, in the context of adjacent or local sequence elements, has a lower propensity of forming an undesirable sequence (e.g., a duplicated sequence or a palindromic sequence) that is refractory to the execution of a task (e.g., cloning or sequencing). Alternatively, segments may be selected such that they contain a carboxyl terminal leucine residue or such that reverse translated sequences encoding the segments contain restriction enzyme sites for convenient splicing of the reverse translated sequences.

The method optionally further comprises linking a spacer oligonucleotide encoding at least one spacer residue between segment-encoding nucleic acids. Such spacer residue(s) may be advantageous in ensuring that epitopes within the segments are processed and presented efficiently. Preferably, the spacer oligonucleotide encodes 2 to 3 spacer residues. The spacer residue is suitably a neutral amino acid, which is preferably alanine.

Optionally, the method further comprises linking in the same reading frame as other segment-containing nucleic acid sequences at least one variant nucleic acid sequence which encodes a variant segment having a homologous but not identical amino acid sequence relative to other encoded segments. Suitably, the variant segment comprises conserved and/or non-conserved amino acid differences relative to one or more other encoded segments. Such differences may correspond to polymorphisms as discussed above. In a preferred embodiment, degenerate bases are designed or built in to the at least one variant nucleic acid sequence to give rise to all desired homologous sequences.

When a large number of polymorphisms is intended to be covered, it is preferred that multiple synthetic polynucleotides are constructed rather than a single synthetic polynucleotide, which encodes all variant segments. For example, if there is less than 85% homology between polymorphic polypeptides, then it is preferred that more than one synthetic polynucleotide is constructed.

Preferably, the method further comprises optimising the codon composition of the synthetic polynucleotide such that it is translated efficiently by a host cell. In this regard, it is well known that the translational efficiency of different codons varies between organisms and that such differences in codon usage can be utilized to enhance the level of protein expression in a particular organism. In this regard, reference may be made to Seed et al. (International Application Publication No WO 96/09378) who disclose the replacement of existing codons in a parent polynucleotide with synonymous codons to enhance expression of viral polypeptides in mammalian host cells. Preferably, the first or second most frequently used codons are employed for codon optimization.

Preferably, gene splicing by overlap extension or "gene SOEing" (supra) is employed for the construction of the synthetic polynucleotide which is a PCR-based method of recombining DNA sequences without reliance on restriction sites and of directly generating mutated DNA fragments in vitro. By modifying the sequences incorporated into the 5'-ends of the primers, any pair of PCR products can be made to share a common sequence at one end. Under PCR conditions, the common sequence allows strands from two different fragments to hybridise to one another, forming an overlap. Extehsion of this overlap by DNA polymerase yields a recombinant molecule. However, a problem with long synthetic constructs is that mutations generally incorporate into amplified products during synthesis. In this instance, it is preferred that resolvase treatment is employed at various steps of the synthesis. Resolvases are bacteriophage-encoded endonucleases which recognise disruptions or mispairing of double stranded DNA and are primarily used by bacteriophages to resolve Holliday junctions (Mizuuchi, 1982; Youil et al., 1995). For example, T7 endonuclease I can be employed in synthetic DNA constructions to recognise mutations and cleave corrupted dsDNA. The mutated DNA strands are then hybridised to non-mutant or correct DNA sequences, which results in a mispairing of DNA bases. The mispaired bases are recognized by the resolvase, which then cleaves the DNA nearby leaving only correctly hybridised sequences intact. Preferably a thermostable resolvase enzyme is employed during splicing or amplification so that errors are not incorporated in downstream synthesis products.

Synthetic polynucleotides according to the invention can be operably linked to a regulatory polynucleotide in the form a synthetic construct as for example described in Section 2 supra. Synthetic constructs of the invention have utility inter alia as nucleic acid vaccines. The choice of regulatory polynucleotide and synthetic construct will depend on the intended host.

Exemplary expression vectors for expression of a synthetic polypeptide according to the invention include, but are not restricted to, modified Ankara Vaccinia virus as for example described by Allen et al. (2000, *J. Immunol.* 164(9): 4968-4978), fowlpox virus as for example described by Boyle and Coupar (1988, *Virus Res.* 10: 343-356) and the herpes simplex amplicons described for example by Fong et al. in U.S. Pat. No. 6,051,428. Alternatively, Adenovirus and Epstein-Barr virus vectors, which are preferably capable of accepting large amounts of DNA or RNA sequence information, can be used.

Preferred promoter sequences that can be utilized for expression of synthetic polypeptides include the P7.5 or PE/L promoters as for example disclosed by Kumar and Boyle. (1990, *Virology* 179:151-158), CMV and RSV promoters.

The synthetic construct optionally further includes a nucleic acid sequence encoding an immunostimulatory molecule. The immunostimulatory molecule may be fusion partner of the synthetic polypeptide. Alternatively, the immunostimulatory molecule may be translated separately from the synthetic polypeptide. Preferably, the immunostimulatory molecule comprises a general immunostimulatory peptide sequence. For example, the immunostimulatory peptide sequence may comprise a domain of an invasin protein (Inv) from the bacteria Yersinia spp as for example disclosed by Brett et al. (1993, *Eur. J. Immunol.* 23: 1608-1614). This immune stimulatory property results from the capability of this invasin domain to interact with the β1 integrin molecules present on T cells, particularly activated immune or memory T cells. A preferred embodiment of the invasin domain (Inv) for linkage to a synthetic polypeptide has been previously described in U.S. Pat. No. 5,759,551. The said Inv domain has the sequence: Thr-Ala-Lys-Ser-Lys-Lys-Phe-Pro-Ser-Tyr-Thr-Ala-Thr-Tyr-Gln-Phe [SEQ ID NO; 1467] or is an immune stimulatory homologue thereof from the corresponding region in another Yersinia species invasin protein. Such homologues thus may contain substitutions, deletions or insertions of amino acid residues to accommodate strain to strain variation, provided that the homologues retain immune stimulatory properties. The general immunostimulatory sequence may optionally be linked to the synthetic polypeptide by a spacer sequence.

In an alternate embodiment, the immunostimulatory molecule may comprise an immunostimulatory membrane or soluble molecule, which is suitably a T cell co-stimulatory molecule. Preferably, the T cell co-stimulatory molecule is a B7 molecule or a biologically active fragment thereof, or a variant or derivative of these. The B7 molecule includes, but is not restricted to, B7-1 and B7-2. Preferably, the B7 molecule is B7-1. Alternatively, the T cell co-stimulatory molecule may be an ICAM molecule such as ICAM-1 and ICAM-2.

In another embodiment, the immunostimulatory molecule can be a cytokine, which includes, but is not restricted to, an interleukin, a lymphokine, tumour necrosis factor and an interferon. Alternatively, the immunostimulatory molecule may comprise an immunomodulatory oligonucleotide as for example disclosed by Krieg in U.S. Pat. No. 6,008,200.

Suitably, the size of the synthetic polynucleotide does not exceed the ability of host cells to transcribe, translate or proteolytically process and present epitopes to the immune system. Practitioners in the art will also recognise that the size of the synthetic polynucleotide can impact on the capacity of an expression vector to express the synthetic polynucleotide in a host cell. In this connection, it is known that the efficacy of DNA vaccination reduces with expression vectors greater that 20-kb. In such situations it is preferred that a larger number of smaller synthetic constructs is utilized rather than a single large synthetic construct.

4. Immunopotentiating Compositions

The invention also contemplates a composition, comprising an immunopotentiating agent selected from the group consisting of a synthetic polypeptide as described in Section 2, and a synthetic polynucleotide or a synthetic construct as described in Section 3, together with a pharmaceutically acceptable carrier. One or more immunopotentiating agents can be used as actives in the preparation of immunopotentiating compositions. Such preparation uses routine methods known to persons skilled in the art. Typically, such compositions are prepared as injectables, either as liquid solutions or suspensions; solid forms suitable for solution in, or suspension in, liquid prior to injection may also be prepared. The preparation may also be emulsified. The active immunogenic ingredients are often mixed with excipients that are pharmaceutically acceptable and compatible with the active ingredient. Suitable excipients are, for example, water, saline, dextrose, glycerol, ethanol, or the like and combinations thereof. In addition, if desired, the vaccine may contain minor amounts of auxiliary substances such as wetting or emulsifying agents, pH buffering agents, and/or adjuvants that enhance the effectiveness of the vaccine. Examples of adjuvants which may be effective include but are not limited to: aluminium hydroxide, N-acetyl-muramyl-L-threonyl-D-isoglutamine (thur-MDP), N-acetyl-nor-muramyl-L-alanyl-D-isoglutamine (CGP 11637, referred to as nor-MDP), N-acetylmuramyl-L-alanyl-D-isoglutaminyl-L-alanine-2-(1'-2'-dipalmitoyl-sn-glycero-3-hydroxyphosphoryloxy)-ethylamine (CGP 1983A, referred to as MTP-PE), and RIBI, which contains three components extracted from bacteria, monophosphoryl lipid A, trehalose dimycolate and cell wall skeleton (MPL+TDM+CWS) in a 2% squalene/Tween 80 emulsion. For example, the effectiveness of an adjuvant may be determined by measuring the amount of antibodies resulting from the administration of the composition, wherein those antibodies are directed against one or more antigens presented by the treated cells of the composition.

The immunopotentiating agents may be formulated into a composition as neutral or salt forms. Pharmaceutically acceptable salts include the acid addition salts (formed with free amino groups of the peptide) and which are formed with inorganic acids such as, for example, hydrochloric or phosphoric acids, or such organic acids such as acetic, oxalic, tartaric, maleic, and the like. Salts formed with the free carboxyl groups may also be derived from inorganic basis such as, for example, sodium, potassium, ammonium, calcium, or ferric hydroxides, and such organic basis as isopropylamine, trimethylamine, 2-ethylamino ethanol, histidine, procaine, and the like.

If desired, devices or compositions containing the immunopotentiating agents suitable for sustained or intermittent release could be, in effect, implanted in the body or topically applied thereto for the relatively slow release of such materials into the body.

The compositions are conventionally administered parenterally, by injection, for example, either subcutaneously or intramuscularly. Additional formulations which are suitable for other modes of administration include suppositories and, in some cases, oral formulations. For suppositories, traditional binders and carriers may include, for example, polyalkylene glycols or triglycerides; such suppositories may be formed from mixtures containing the active ingredient in the range of 0.5% to 10%, preferably 1%-2%. Oral formulations include such normally employed excipients as, for example, pharmaceutical grades of mannitol, lactose, starch, magnesium carbonate, and the like. These compositions take the form of solutions, suspensions, tablets, pills, capsules, sustained release formulations or powders and contain 10%-95% of active ingredient, preferably 25%-70%.

Administration of the gene therapy construct to said mammal, preferably a human, may include delivery via direct oral intake, systemic injection, or delivery to selected tissue(s) or cells, or indirectly via delivery to cells isolated from the mammal or a compatible donor. An example of the latter approach would be stem cell therapy, wherein isolated stem cells having potential for growth and differentiation are transfected with the vector comprising the Sox18 nucleic acid. The stem cells are cultured for a period and then transferred to the mammal being treated.

With regard to nucleic acid based compositions, all modes of delivery of such compositions are contemplated by the present invention. Delivery of these compositions to cells or tissues of an animal may be facilitated by microprojectile bombardment, liposome mediated transfection (e.g., lipofectin or lipofectamine), electroporation, calcium phosphate or DEAE-dextran-mediated transfection, for example. In an alternate embodiment, a synthetic construct may be used as a therapeutic or prophylactic composition in the form of a "naked DNA" composition as is known in the art. A discussion of suitable delivery methods may be found in Chapter 9 of CURRENT PROTOCOLS IN MOLECULAR BIOLOGY (Eds. Ausubel et al.; John Wiley & Sons Inc., 1997 Edition) or on the Internet site DNAvaccine.com. The compositions may be administered by intradermal (e.g., using panjet™ delivery) or intramuscular routes.

The step of introducing the synthetic polynucleotide into a target cell will differ depending on the intended use and species, and can involve one or more of non-viral and viral vectors, cationic liposomes, retroviruses, and adenoviruses such as, for example, described in Mulligan, R.C., (1993 *Science* 260 926-932) which is hereby incorporated by reference. Such methods can include, for example:

A. Local application of the synthetic polynucleotide by injection (Wolff et al., 1990, *Science* 247 1465-1468, which is hereby incorporated by reference), surgical implantation, instillation or any other means. This method can also be used in combination with local application by injection, surgical implantation, instillation or any other means, of cells responsive to the protein encoded by the synthetic polynucleotide so as to increase the effectiveness of that treatment. This method can also be used in combination with local application by injection, surgical implantation, instillation or any other means, of another factor or factors required for the activity of said protein.

B. General systemic delivery by injection of DNA, (Calabretta et al., 1993, *Cancer Treat. Rev.* 19 169-179, which is incorporated herein by reference), or RNA, alone or in combination with liposomes (Zhu et al., 1993, *Science* 261 209-212, which is incorporated herein by reference), viral capsids or nanoparticles (Bertling et al., 1991, *Biotech. Appl. Biochem*. 13 390-405, which is incorporated herein by reference) or any other mediator of delivery. Improved targeting might be achieved by linking the synthetic polynucleotide to a targeting molecule (the so-called "magic bullet" approach employing, for example, an antibody), or by local application by injection, surgical implantation or any other means, of another factor or factors required for the activity of the protein encoding said synthetic polynucleotide, or of cells responsive to said protein.

C. Injection or implantation or delivery by any means, of cells that have been modified ex vivo by transfection (for example, in the presence of calcium phosphate: Chen et al., 1987, *Mole. Cell Biochem*. 7 2745-2752, or of cationic lipids and polyamines: Rose et al., 1991, *BioTech*. 10 520-

525, which articles are incorporated herein by reference), infection, injection, electroporation (Shigekawa et al., 1988, *BioTech*. 6 742-751, which is incorporated herein by reference) or any other way so as to increase the expression of said synthetic polynucleotide in those cells. The modification can be mediated by plasmid, bacteriophage, cosmid, viral (such as adenoviral or retroviral; Mulligan, 1993, *Science* 260 926-932; Miller, 1992, *Nature* 357 455-460; Salmons et al., 1993, *Hum. Gen. Ther*. 4 129-141, which articles are incorporated herein by reference) or other vectors, or other agents of modification such as liposomes (Zhu et al., 1993, *Science* 261 209-212, which is incorporated herein by reference), viral capsids or nanoparticles (Bertling et al., 1991, *Biotech. Appl. Biochem*. 13 390-405, which is incorporated herein by reference), or any other mediator of modification. The use of cells as a delivery vehicle for genes or gene products has been described by Barr et al., 1991, *Science* 254 1507-1512 and by Dhawan et al., 1991, *Science* 254 1509-1512, which articles are incorporated herein by reference. Treated cells can be delivered in combination with any nutrient, growth factor, matrix or other agent that will promote their survival in the treated subject.

Also encapsulated by the present invention is a method for treatment and/or prophylaxis of a disease or condition, comprising administering to a patient in need of such treatment a therapeutically effective amount of a composition as broadly described above. The disease or condition may be caused by a pathogenic organism or a cancer as for example described above.

In a preferred embodiment, the immunopotentiating composition of the invention is suitable for treatment of, or prophylaxis against, a cancer. Cancers which could be suitably treated in accordance with the practices of this invention include cancers of the lung, breast, ovary, cervix, colon, head and neck, pancreas, prostate, stomach, bladder, kidney, bone liver, oesophagus, brain, testicle, uterus, melanoma and the various leukemias and lymphomas.

In an alternate embodiment, the immunopotentiating composition is suitable for treatment of, or prophylaxis against, a viral, bacterial or parasitic infection. Viral infections contemplated by the present invention include, but are not restricted to, infections caused by HIV, Hepatitis, Influenza, Japanese encephalitis virus, Epstein-Barr virus and respiratory syncytial virus. Bacterial infections include, but are not restricted to, those caused by *Neisseria* species, *Meningococcal* species, *Haemophilus* species *Salmonella* species, *Streptococcal* species, *Legionella* species and *Mycobacterium* species. Parasitic infections encompassed by the invention include, but are not restricted to, those caused by *Plasmodium* species, *Schistosoma* species, *Leishmania* species, *Trypanosoma* species, *Toxoplasma* species and *Giardia* species.

The above compositions or vaccines may be administered in a manner compatible with the dosage formulation, and in such amount as is therapeutically effective to alleviate patients from the disease or condition or as is prophylactically effective to prevent incidence of the disease or condition in the patient. The dose administered to a patient, in the context of the present invention, should be sufficient to effect a beneficial response in a patient over time such as a reduction or cessation of blood loss. The quantity of the composition or vaccine to be administered may depend on the subject to be treated inclusive of the age, sex, weight and general health condition thereof. In this regard, precise amounts of the composition or vaccine for administration will depend on the judgement of the practitioner. In determining the effective amount of the composition or vaccine to be administered in the treatment of a disease or condition, the physician may evaluate the progression of the disease or condition over time. In any event, those of skill in the art may readily determine suitable dosages of the composition or vaccine of the invention.

In a preferred embodiment, DNA-based immunopotentiating agent (e.g., 100 μg) is delivered intradermally into a patient at day 1 and at week 8 to prime the patient. A recombinant poxvirus (e.g., at $10^7$ pfu/mL) from which substantially the same immunopotentiating agent can be expressed is then delivered intradermally as a booster at weeks 16 and 24, respectively.

The effectiveness of the immunisation may be assessed using any suitable technique. For example, CTL lysis assays may be employed using stimulated splenocytes or peripheral blood mononuclear cells (PBMC) on peptide coated or recombinant virus infected cells using $^{51}Cr$ labelled target cells. Such assays can be performed using for example primate, mouse or human cells (Allen et al., 2000, *J. Immunol*. 164(9): 4968-4978 also Woodberry et al., infra). Alternatively, the efficacy of the immunisation may be monitored using one or more techniques including, but not limited to, HLA class I Tetramer staining—of both fresh and stimulated PBMCs (see for example Allen et al., supra), proliferation assays (Allen et al., supra), Elispot™ Assays and intracellular INF-gamma staining (Allen et al., supra), ELISA Assays—for linear B cell responses; and Western blots of cell sample expressing the synthetic polynucleotides.

5. Computer Related Embodiments

The design or construction of a synthetic polypeptide sequence or a synthetic polynucleotide sequence according to the invention is suitably facilitated with the assistance of a computer programmed with software, which inter alia fragments a parent sequence into fragments, and which links those fragments together in a different relationship relative to their linkage in the parent sequence. The ready use of a parent sequence for the construction of a desired synthetic molecule according to the invention requires that it be stored in a computer-readable format. Thus, in accordance with the present invention, sequence data relating to a parent molecule (e.g. a parent polypeptide) is stored in a machine-readable storage medium, which is capable of processing the data to fragment the sequence of the parent molecule into fragments and to link together the fragments in a different relationship relative to their linkage in the parent molecule.

Therefore, another embodiment of the present invention provides a machine-readable data storage medium, comprising a data storage material encoded with machine readable data which, when used by a machine programmed with instructions for using said data, fragments a parent sequence into fragments, and links those fragments together in a different relationship relative to their linkage in the parent sequence. In a preferred embodiment of this type, a machine-readable data storage medium is provided that is capable of reverse translating the sequence of a respective fragment to provide a nucleic acid sequence encoding the fragment and to link together in the same reading frame each of the nucleic acid sequences to provide a polynucleotide sequence that codes for a polypeptide sequence in which said fragments are linked together in a different relationship relative to their linkage in a parent polypeptide sequence.

In another embodiment, the invention encompasses a computer for designing the sequence of a synthetic polypeptide and/or a synthetic polynucleotide of the invention, wherein the computer comprises wherein said computer comprises: (a) a machine readable data storage medium comprising a data storage material encoded with machine readable data, wherein said machine readable data comprises the sequence of a parent polypeptide; (b) a working memory for storing instructions for processing said machine-readable data; (c) a central-processing unit coupled to said working memory and to said machine-readable data storage medium, for processing said machine-readable data into said synthetic polypeptide sequence and/or said synthetic polynucleotide; and (d) an output hardware coupled to said central processing unit, for receiving said synthetic polypeptide sequence and/or said synthetic polynucleotide.

In yet another embodiment, the invention contemplates a computer program product for designing the sequence of a synthetic polynucleotide of the invention, comprising code that receives as input the sequence of a parent polypeptide, code that fragments the sequence of the parent polypeptide into fragments, code that reverse translates the sequence of a respective fragment to provide a nucleic acid sequence encoding the fragment, code that links together in the same reading frame each said nucleic acid sequence to provide a polynucleotide sequence that codes for a polypeptide sequence in which said fragments are linked together in a different relationship relative to their linkage in the parent polypeptide sequence, and a computer readable medium that stores the codes.

Figure 23:
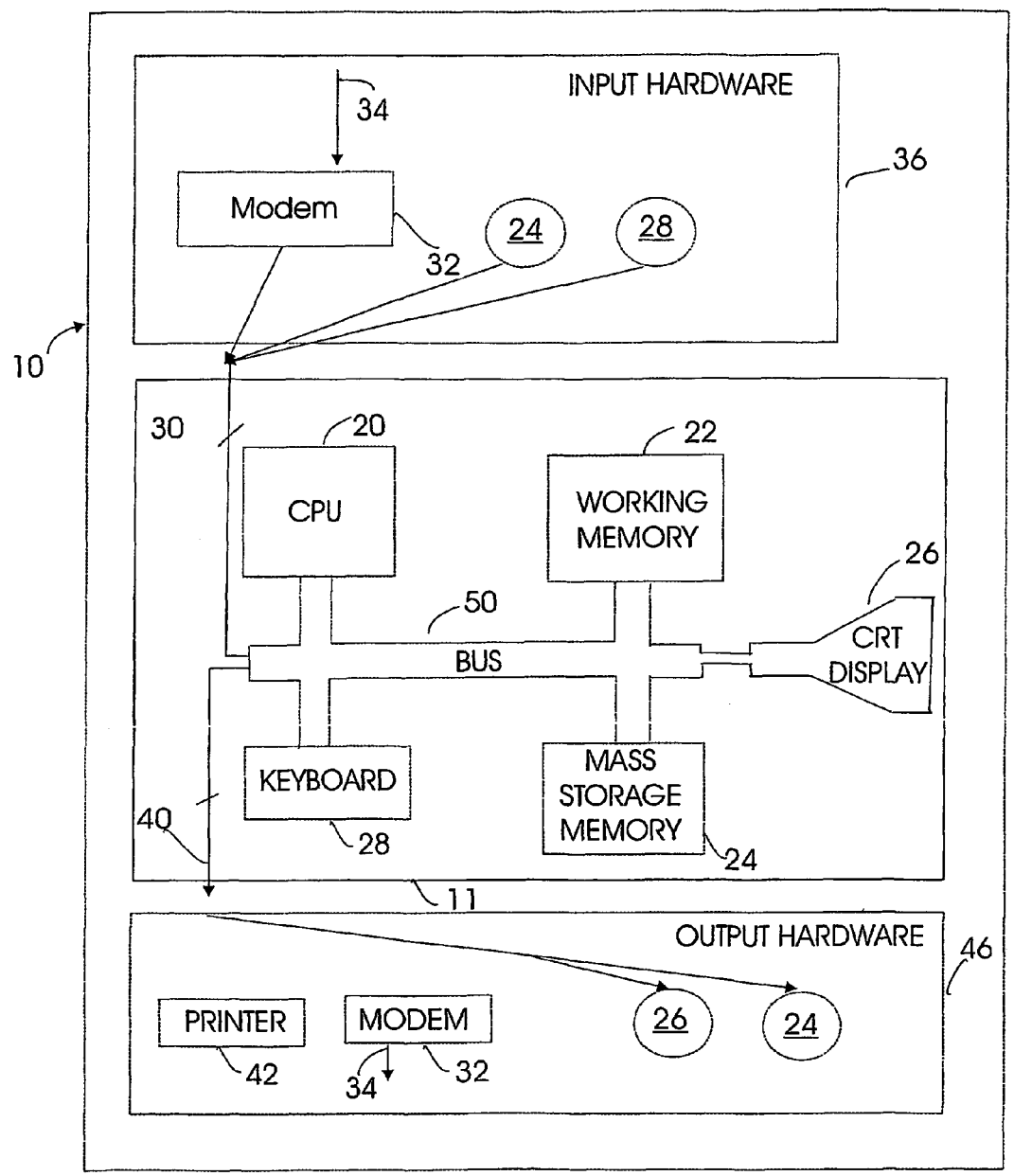
FIG. 23 shows a diagram of a system used to carry out the instructions encoded by the storage medium of FIGS. 28 and 29.

A version of these embodiments is presented in FIG. 23, which shows a system 10 including a computer 11 comprising a central processing unit ("CPU") 20, a working memory 22 which may be, e.g., RAM (random-access memory) or "core" memory, mass storage memory 24 (such as one or more disk drives or CD-ROM drives), one or more cathode-ray tube ("CRT") display terminals 26, one or more keyboards 28, one or more input lines 30, and one or more output lines 40, all of which are interconnected by a conventional bidirectional system bus 50.

Input hardware 36, coupled to computer 11 by input lines 30, may be implemented in a variety of ways. For example, machine-readable data of this invention may be inputted via the use of a modem or modems 32 connected by a telephone line or dedicated data line 34. Alternatively or additionally, the input hardware 36 may comprise CD. Alternatively, ROM drives or disk drives 24 in conjunction with display terminal 26, keyboard 28 may also be used as an input device.

Output hardware 46, coupled to computer 11 by output lines 40, may similarly be implemented by conventional devices. By way of example, output hardware 46 may include CRT display terminal 26 for displaying a synthetic polynucleotide sequence or a synthetic polypeptide sequence as described herein. Output hardware might also include a printer 42, so that hard copy output may be produced, or a disk drive 24, to store system output for later use.

Figure 24:
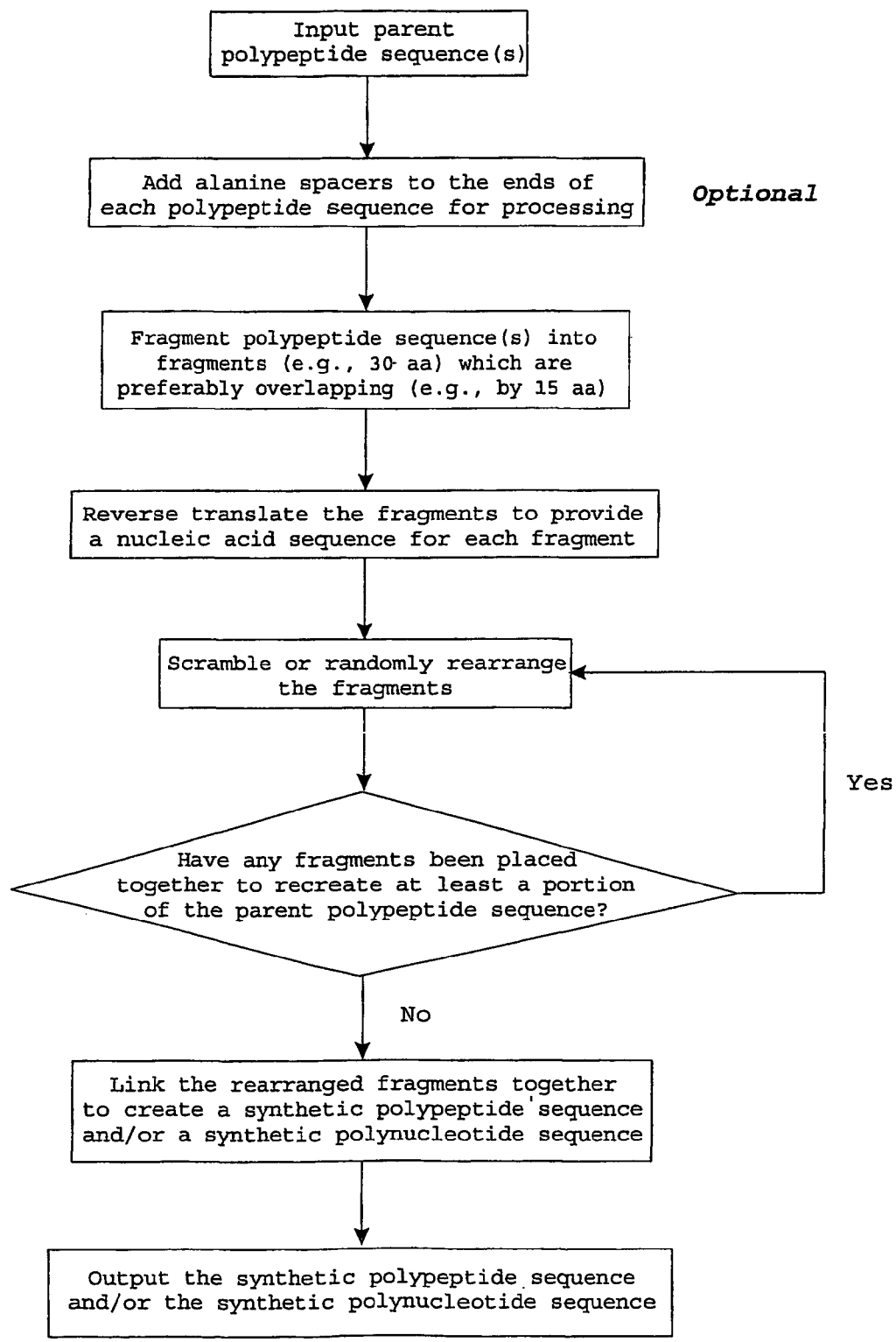
FIG. 24 depicts a flow diagram showing an embodiment of a method for designing synthetic polynucleotide and synthetic polypeptides of the invention.
Figure 27:
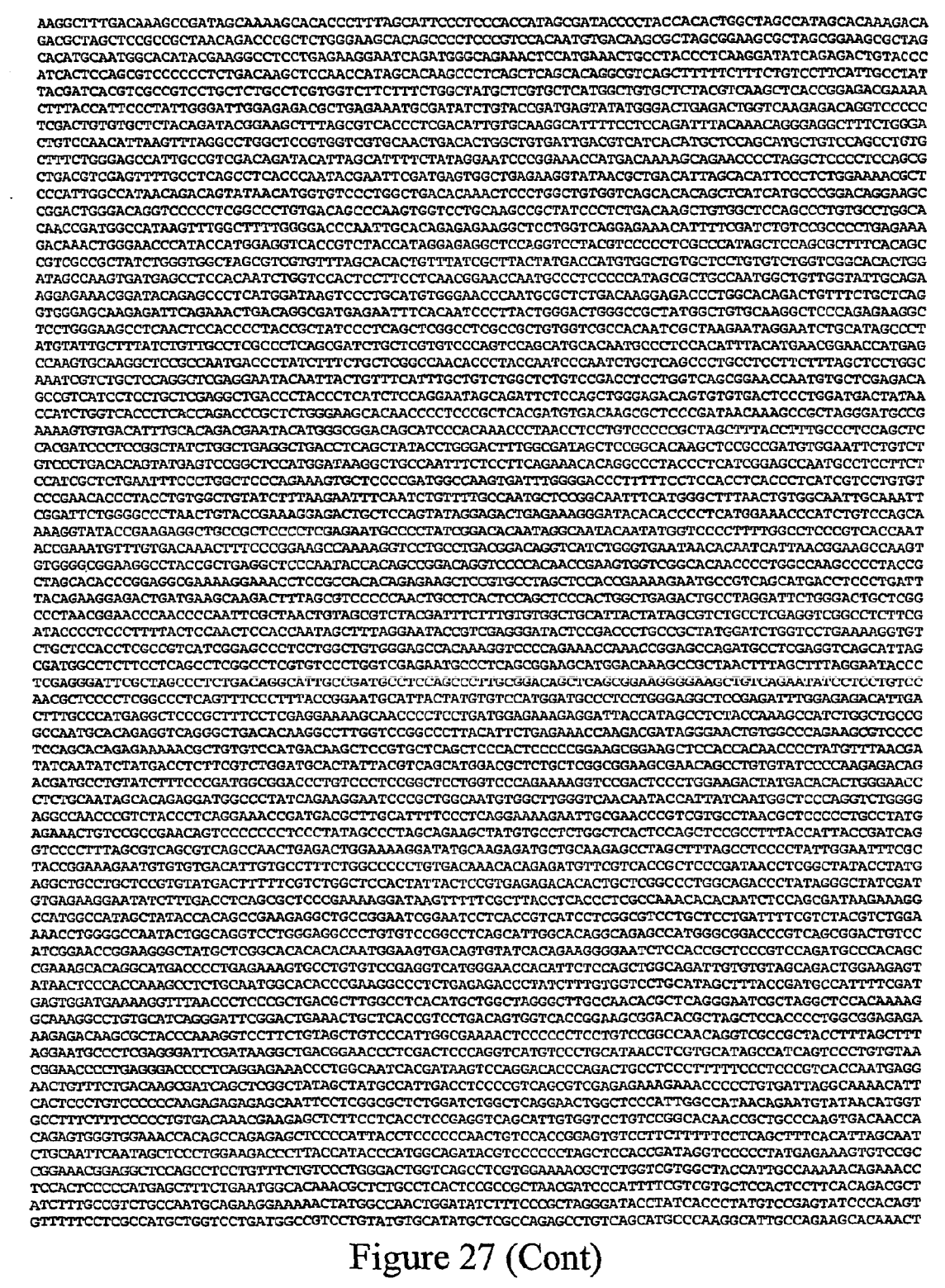

In operation, CPU 20 coordinates the use of the various input and output devices 36,46 coordinates data accesses from mass storage 24 and accesses to and from working memory 22, and determines the sequence of data processing steps. A number of programs may be used to process the machine readable data of this invention. Exemplary programs may use for example the steps outlined in the flow diagram illustrated in FIG. 24. Broadly, these steps include (1) inputting at least one parent polypeptide sequence; (2) optionally adding to alanine spacers at the ends of each polypeptide sequence; (3) fragmenting the polypeptide sequences into fragments (e.g., 30 amino acids long), which are preferably overlapping (e.g., by 15 amino acids); (4) reverse translating the fragment to provide a nucleic acid sequence for each fragment and preferably using for the reverse translation first and second most translationally efficient codons for a cell type, wherein the codons are preferably alternated out of frame with each other in the overlaps of consecutive fragments; (5) randomly rearranging the fragments; (6) checking whether rearranged fragments recreate at least a portion of a parent polypeptide sequence; (7) repeating randomly rearranging the fragments when rearranged fragments recreate said at least a portion; or otherwise (8) linking the rearranged fragments together to produce a synthetic polypeptide sequence and/or a synthetic polynucleotide sequence; and (9) outputting said synthetic polypeptide sequence and/or a synthetic polynucleotide sequence. An example of an algorithm which uses inter alia the aforementioned steps is shown in FIG. 25. By way of example, this algorithm has been used for the design of synthetic polynucleotides and synthetic polypeptides according to the present invention for Hepatitis C1a and for melanoma, as illustrated in FIGS. 26 and 27.

Figure 28:
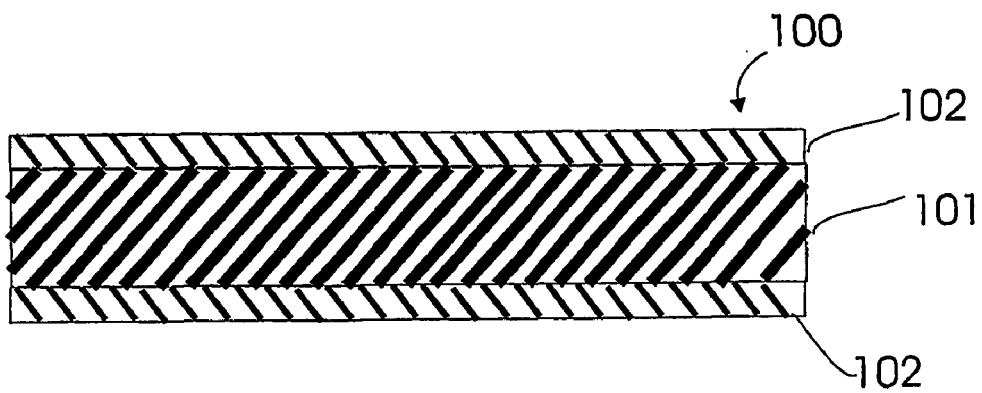
FIG. 28 shows a cross section of a magnetic storage medium.

FIG. 28 shows a cross section of a magnetic data storage medium 100 which can be encoded with machine readable data, or set of instructions, for designing a synthetic molecule of the invention, which can be carried out by a system such as system 10 of FIG. 23. Medium 100 can be a conventional floppy diskette or hard disk, having a suitable substrate 101, which may be conventional, and a suitable coating 102, which may be conventional, on one or both sides, containing magnetic domains (not visible) whose polarity or orientation can be altered magnetically. Medium 100 may also have an opening (not shown) for receiving the spindle of a disk drive or other data storage device 24. The magnetic domains of coating 102 of medium 100 are polarised or oriented so as to encode in manner which may be conventional, machine readable data such as that described herein, for execution by a system such as system 10 of FIG. 23.

Figure 29:
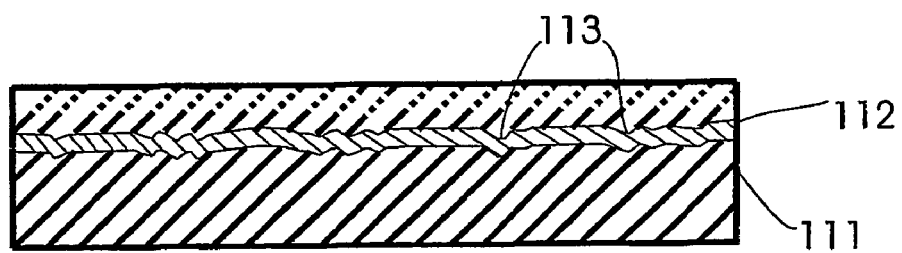
FIG. 29 shows a cross section of an optically readable data storage medium.

FIG. 29 shows a cross section of an optically readable data storage medium 110 which also can be encoded with such a machine-readable data, or set of instructions, for designing a synthetic molecule of the invention, which can be carried out by a system such as system 10 of FIG. 23. Medium 110 can be a conventional compact disk read only memory (CD-ROM) or a rewritable medium such as a magneto-optical disk, which is optically readable and magneto-optically writable. Medium 100 preferably has a suitable substrate 111, which may be conventional, and a suitable coating 112, which may be conventional, usually of one side of substrate 111.

In the case of CD-ROM, as is well known, coating 112 is reflective and is impressed with a plurality of pits 113 to encode the machine-readable data. The arrangement of pits is read by reflecting laser light off the surface of coating 112. A protective coating 114, which preferably is substantially transparent, is provided on top of coating 112.

In the case of a magneto-optical disk, as is well known, coating 112 has no pits 113, but has a plurality of magnetic domains whose polarity or orientation can be changed magnetically when heated above a certain temperature, as by a laser (not shown). The orientation of the domains can be read by measuring the polarisation of laser light reflected from coating 112. The arrangement of the domains encodes the data as described above.

In order that the invention may be readily understood and put into practical effect, particular preferred non-limiting embodiments will now be described as follows.

EXAMPLES

Example 1

Preparation of an HIV Savine

Experimental Protocol

Plasmids

The plasmid pDNAVacc is ampicillin resistant and contains an expression cassette comprising a CMV promoter and enhancer, a synthetic intron, a multiple cloning site (MCS) and a SV40poly A signal sequence (Thomson et al., 1998). The plasmid pTK7.5 and contains a selection cassette, a pox virus 7.5 early/late promoter and a MCS flanked on either side by Vaccinia virus TK gene sequences.

Recombinant Vaccinia Viruses

Recombinant Vaccinia viruses expressing the gag, env (IIB) and pol (LAI) genes of HIV-1 were used as previously described and denoted VV-GAG, VV-POL, VV-ENV (Woodberry et al., 1999; Kent et al., 1998).

Marker Rescue Recombination

Recombinant Vaccinia viruses containing Savine constructs were generated by marker rescue recombination, using protocols described previously (Boyle et al., 1985). Plaque purified viruses were tested for the TK phenotype and for the appropriate genome arrangement by Southern blot and PCR.

Oligonucleotides

Oligonucleotides 50 nmol scale and desalted were purchased from Life Technologies. Short oligonucleotides were resuspended in 100 μL of water, their concentration determined, then diluted to 20 μM for use in PCR or sequencing reactions. Long oligonucleotides for splicing reactions were denatured for 5 minutes at 94° C. in 20 μL of formamide loading buffer then 0.5 μL gel purified on a 6% polyacrylamide gel. Gel slices containing full-length oligonucleotides were visualised with ethidium bromide, excised, placed in Eppendorf™ tubes, combined with 200 μL of water before being crushed using the plunger of a 1 mL syringe. Before being used in splicing reactions the crushed gel was resuspended in an appropriate volume of buffer and 1-2 μL of the resuspendate used directly in the splicing reactions.

Sequencing

Sequencing was performed using Dye terminator sequencing reactions and analyzed by the Biomedical Resource Facility at the John Curtin School of Medical Research using an ABI automated sequencer.

Restimulation of Lymphocytes from HIV Infected Patients

Two pools of recombinant Vaccinia viruses containing VV-AC1+VV-BC1 (Pool 1) or VV-AC2+VV-BC2+VV-CC2 (Pool 2) were used to restimulate lymphocytes from the blood samples of HIV-infected patients. Briefly CTL lines were generated from HIV-infected donor PBMC. A fifth of the total PBMC were infected with either Pool 1 or Pool 2 Vaccinia viruses then added back to the original cell suspension. The infected cell suspension was then cultured with IL-7 for 1 week.

CTL Assays

Restimulated PBMCs were used as effectors in a standard $^{51}$Cr-release CTL assay. Targets were autologous EBV-transformed lymphoblastoid cell lines (LCLs) infected with the following viruses: Pool 1, Pool 2, VV-GAG, VV-POL or VV-ENV. Assay controls included uninfected targets, targets infected with VV-lacZ (virus control) and K562 cells.

Results

HIV Savine Design

A main goal of the Savine strategy is to include as much protein sequence information from a pathogen or cancer as possible in such a way that potential T cell epitopes remain intact and so that the vaccine or therapy is extremely safe. An HIV Savine is described herein not only to compare this strategy to other strategies but also, to produce an HIV vaccine that would provide the maximum possible population coverage as well as catering for the major HIV clades.

A number of design criteria was first determined to exploit the many advantages of using a synthetic approach. One advantage is that it is possible to use consensus protein sequences to design these vaccines. Using consensus sequences for a highly variable virus like HIV should provide better vaccine coverage because individual viral isolate sequences may have lost epitopes which induce CTL against the majority of other viral isolates. Thus, using the-consensus sequences of each HIV lade rather than individual isolate sequences should provide better vaccine coverage. Taking this one step further, a consensus sequence that covers all HIV clades should theoretically provide better coverage than using just the consensus sequences for individual clades. Before designing such a sequence however, it was decided that a more appropriate and focussed HIV vaccine might be constructed if the various clades were first ranked according to their relative importance. To establish such a ranking the following issues were considered, current prevalence of each lade, the rate at which each lade is increasing and the capacity of various regions of the world to cope with the HIV pandemic (FIGS. 1 and 2). These criteria produced the following ranking, Clade E≧clade A>clade C>clade B>cldade D>other clades. Clades E and A were considered to almost equal since they are very similar except in their envelope protein sequences, which differ considerably.

Another advantage of synthesising a designed sequence is that it is possible to incorporate degenerate sequences into their design. In the case of HIV, this means that more than one amino acid can be included at various positions to improve the ability of the vaccine to cater for the various HIV clades and isolates. Coverage is improved because mutations in different HIV clades and also in individual isolate sequences, while mostly destroying specific T cell epitopes, can result in the formation of new potentially useful epitopes nearby (Goulder et al., 1997). Incorporating degenerate amino acid sequences, however, also means that more than one construct must be made and mixed together. The number of constructs required depends on the frequency with which mutations are incorporated into the design. While this approach requires the construction of additional constructs, these constructs can be prepared from the same set of degenerate long oligonucleotides, significantly reducing the cost of providing such considerable interclade coverage.

A set of degeneracy rules was developed for the incorporation of amino acid mutations into the design which meant that a maximum of eight constructs would be required so that theoretically all combinations were present, as follows: 1) Two amino acids at three positions (or less) within any group of nine amino acids (i.e., present in a CTL epitope); 2) Three amino acids at one position and two at another (or not) within any group of nine amino acids; 3) Four amino acids at one position and two at another (or not) within any group of nine amino acids. The reason why these rules were applied to nine amino acids (the average CTL epitope size) and not to larger stretches of amino acid sequence to cater for class II restricted epitopes, is because class II-restricted epitopes generally have a core sequence of nine amino acids in the middle which bind specifically to class II MHC molecules with the extra flanking sequences stabilising binding, by associating with either side of class II MHC antigens in a largely sequence independent manner (Brown et al., 1993).

Using the HIV clade ranking described above, the amino acid degeneracy rules and in some situations the similarity between amino acids, a degenerate consensus protein sequence was designed for each HIV protein using the consensus protein sequences for Molecular Immunology Database, 1997). It is important to note that in some situations the order with which each of the above design criteria was applied was altered. Each time this was done the primary goal however was to increase the ability of the Savine to cater for interclade differences. Two isolate sequences, GenBank accession U51189 and U46016, for lade E and lade C, respectively, were used when a consensus sequence for some HIV proteins from these two clades was unavailable (Gao et al., 1996; Salminen et al., 1996). The design of a consensus sequence for the hypervariable regions of the HIV envelope protein and in some cases between these regions (hypervariable regions 1-2 and 3-5) was difficult and so these regions were excluded from the vaccine design.

Once a degenerate consensus sequence was designed for each HIV protein, an approach was then determined for incorporating all the protein sequences safely into the vaccine. One convenient approach to ensure that a vaccine will be safe is to systematically fragment and randomly rearrange the protein sequences together thus abrogating or otherwise altering their structure and function. The protein sequences still have to be immunologically functional however, meaning that the process used to fragment the sequences should not destroy potential epitopes. To decide on the best approach for systematically fragmenting protein sequences, the main criteria used was the size of T epitopes and their processing requirements. Class I-restricted T cell epitopes are 8-10 amino acids long and generally require 2-3 natural flanking amino acids to ensure their efficient processing and presentation if placed next to unnatural flanking residues (Del Val et al., 1991; Thomson et al., 1995). Class II-restricted T cell epitopes range between 12-25 amino acids long and do appear to require natural flanking residues for processing however, it is difficult to rule out a role for natural flanking residues in all cases due to the complexity of their processing pathways (Thomson et al., 1998). Also class II-restricted epitopes despite being larger than CTL epitopes generally have a core sequence of 9-10 amino acids, which binds to MHC molecules in a sequence specific fashion. Thus, based on current knowledge, it was decided that an advantageous approach was to overlap the fragments by at least 15 amino acids to ensure that potential epitopes which might lie across fragment boundaries are not lost and to ensure that CTL epitopes near fragment boundaries, that are placed beside or near inhibitory amino acids in adjacent fragments, are processed efficiently. In deciding the optimal fragment size, the main criteria used were that size had to be small enough to cause the maximum disruption to the structure and function of proteins but large enough to cover the sequence information as efficiently as possible without any further unnecessary duplication. Based on these criteria the fragments would be twice the overlap size, in this case 30 amino acids long.

Figure 12:
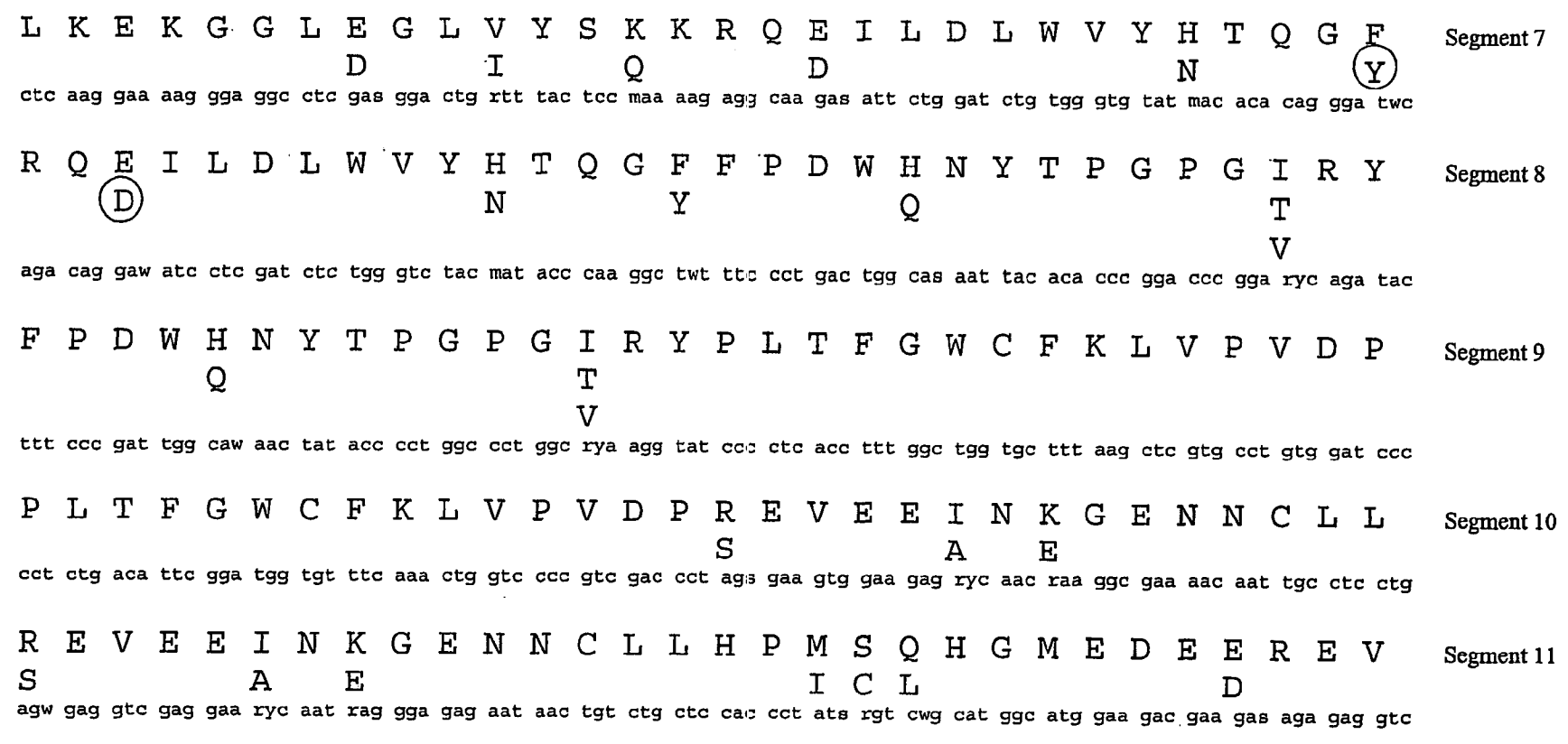

The designed degenerate protein sequences were then separated into fragments 30 amino acid long and overlapping by fifteen amino acids. Two alanine amino acids were also added to the start and end of the first and last fragment for each protein or envelop protein segment to ensure these fragments were not placed directly adjacent to amino acids capable of blocking epitope processing (Del Val et al., 1991). The next step was to reverse translate each protein sequence back into DNA. Duplicating DNA sequences was avoided when constructing DNA sequences encoding a tandem repeat of identical or homologous amino acid sequences to maximise expression of the Savine. In this regard, the first and second most commonly used mammalian codons (shown in FIG. 12) were assigned to amino acids in these repeat regions, wherein a first codon was used to encode an amino acid in one of the repeated sequences and wherein a second but synonymous codon was used for the other repeated sequence (e.g., see the gag HIV protein in FIG. 13). To cater for the designed amino acid mutations more than one base was assigned to some positions using the IUPAC DNA codes without exceeding more than three base variations (eight possible combinations) in any group of 27 bases (FIG. 12). Where a particular combination of amino acids could not be incorporated, because too many degenerate bases would be required, some or all of the amino acid degeneracy was removed according to the protein consensus design rules outlined above. Also the degenerate codons were checked to determine if they could encode a stop codon, if stop codons could not be avoided then the amino acid degeneracy was also simplified again according to the protein consensus design rules outlined above.

Figure 14:
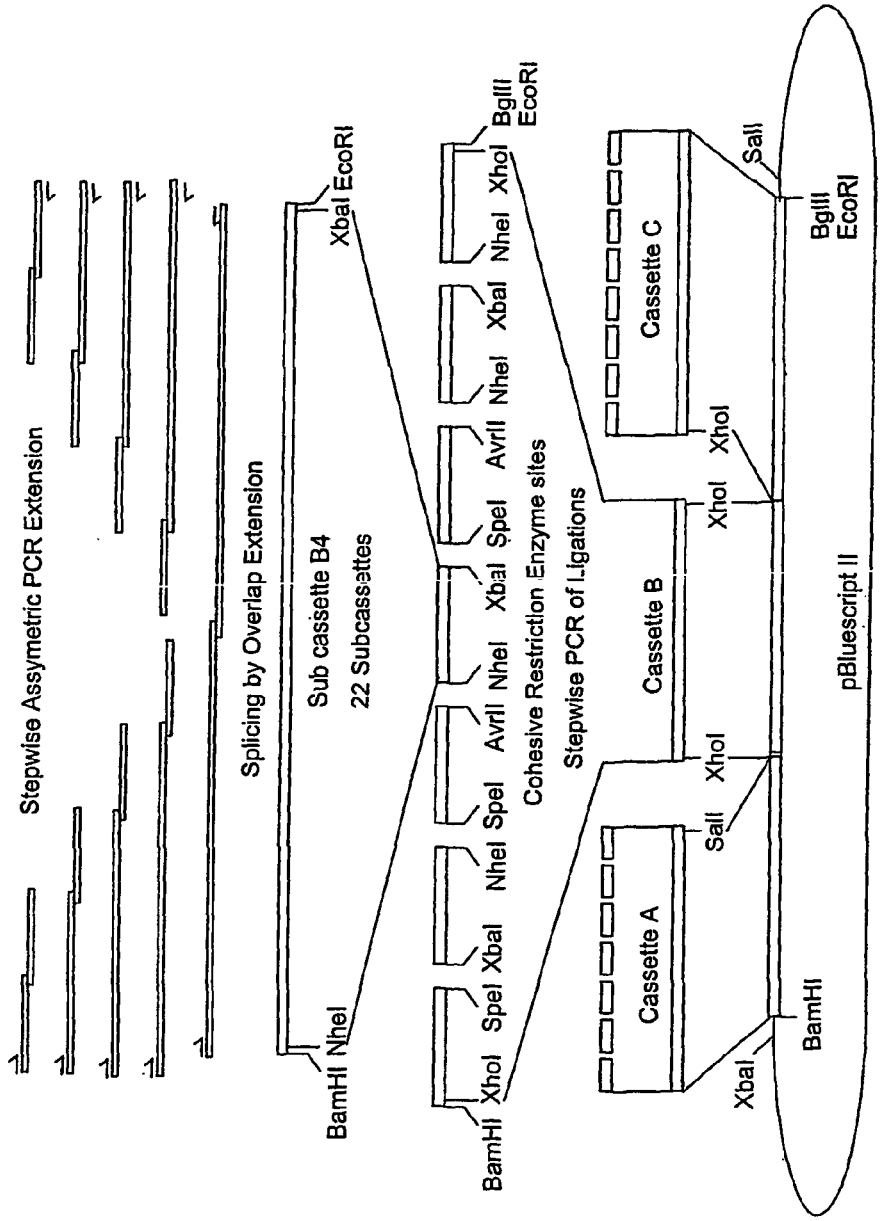
Figure 15:
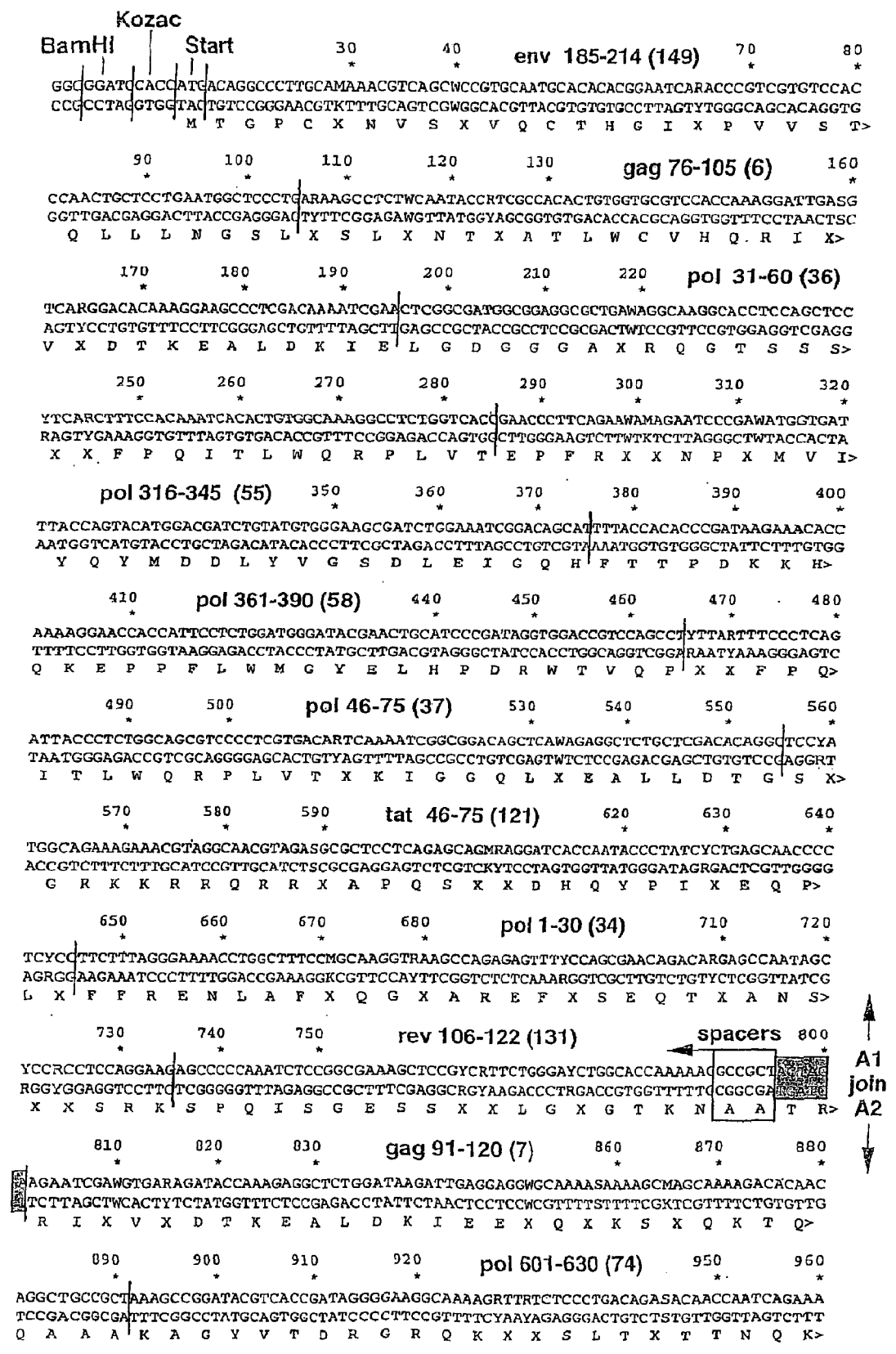

The designed DNA segments were then scrambled randomly and joined to create twenty-two subcassettes approximately 840 bp in size. Extra DNA sequences incorporating sites for one of the cohesive restriction enzymes XbaI, SpeI, AvrII or NheI and 3 additional base pairs (to cater for premature Taq polymerase termination) were then added to each end of each subcassette (FIG. 14). Some of these extra DNA sequences also contained, the cohesive restriction sites for SalI or XhoI, Kozak signal sequences and start or stop codons to enable the subcassettes to be joined and expressed either as three large cassettes or one full length protein (FIGS. 14 and 15).

In designing the HIV Savine one issue that required investigation was whether such a large DNA molecule would be fully expressed and Whether epitopes encoded near the end of the molecule would be efficiently presented to the immune system. The inventors also wished to show that mixing two or more degenerate Savine constructs together could induce T cell responses that recognise mutated sequences. To examine both issues DNA coding for a degenerate murine influenza nucleoprotein CTL epitope, NP365-373, which differs by two amino acids at positions 71 and 72 in influenza strain A/PR/8/34 compared to the A/NT/60/68 strain and restricted by H2-Db, was inserted before the last stop codon at the end of the HIV Savine design (FIG. 15). An important and unusual characteristic of both of these naturally occurring NP365-373 sequences, which enabled the present inventors to examine the effectiveness of incorporating mutated sequences, is that they generate CTL responses which do not cross react with the alternate sequence (Townsend et. al., 1986). This is an unusual characteristic because epitopes not destroyed by mutation usually induce CTL responses that cross-react.

Up to ten long oligonucleotides up to 100 bases long and two short amplification oligonucleotides were synthesized to enable construction of each subcassette (Life Technologies). In designing each oligonucleotide the 3' end and in most cases also the 5' end had to be either a 'c' or a 'g' to ensure efficient extension during PCR splicing. The overlap region for each long oligonucleotide was designed to be at least 16 bp with approximately 50% G/C content. Also oligonucleotide overlaps were not placed where degenerate DNA bases coded for degenerate amino acids to avoid splicing difficulties later. Where this was too difficult some degenerate bases were removed according to the protein consensus design rules outlined above and indicated in FIG. 12 FIG. 16 shows an example of the oligonucleotides design for each subcassette.

Construction of the HIV Savine

Five of each group of ten designed oligonucleotides were spliced together using stepwise asymmetric PCR (Sandhu et al., 1992) and Splicing by Overlap Extension (SOEing) (FIG. 17a). Each subcassette was then PCR amplified, cloned into pBluescript™ II KS⁻ using BamHI/EcoRI and 16 individual clones sequenced. Mutations, deletions and insertions were present in the large majority of the clones for each subcassette, despite acrylamide gel purification of the long oligonucleotides. In order to construct a fictional Savine with minimal mutations, two clones for each subcassette with no insertions or deletions and hence a complete open reading frame and with minimal numbers of non-designed mutations, were selected from the sixteen available. The subcassettes were then excised from their plasmids and joined by stepwise PCR-amplified ligation using the polymerase blend Elongase™ (Life Technology), T4 DNA ligase and the cohesive restriction enzymes XbaI/SpeI/AvrII/NheI, to generate two copies of cassettes A, B and C as outlined in FIG. 14 and shown in FIG. 17b. Predicted sequences for these cassettes are shown in FIG. 30. Each cassette was then reamplified by PCR with Elongase™, cloned into pBluescript™ II KS⁻ and 3 of the resulting plasmid clones sequenced using 12 of the 36 sequencing primers designed to cover the full length construct. Clones with minimal or no further mutations were selected for transfer into plasmids for DNA vaccination or used to make recombinant poxviruses. A summary of the number of designed and non-designed mutations in each Savine construct is presented in Table 1.

TABLE 1

Summary of mutations

| Construct | No. aas | Designed | Expected in 2 clones | Actual in 2 clones | Non-designed |
|---|---|---|---|---|---|
| Cassette A | 1896 | 249 | 124 | 107 | 5 (AC1), 8 (AC2) |
| Cassette B | 1184 | 260 | 130 | 124 | 11 (BC1), 4 (BC2) |
| Cassette C | 1969 | 276 | 138 | 121 | 10 (CC1), 14 (CC2) |
| Full length | 5742 | 785 | 392 | 352 | 26 (FL1), 26 (FL2) |

Summary of the mutations present in the two full-length clones constructed as determined by sequencing. Includes the number of mutations designed, expected and actually present in the 2 clones and the number of non-designed mutations in each cassette and full-length clone.

HIV Savine DNA vaccines and Recombinant Vaccinia viruses

To test the immunological effectiveness of the HIV Savine constructs the cassette sequences were transferred into DNA vaccine and poxvirus vectors. These vectors when used either separately in immunological assays described below or together in a 'prime-boost' protocol which has been shown previously to generate strong T cell responses in vivo (Kent et al., 1997).

Figure 18A:
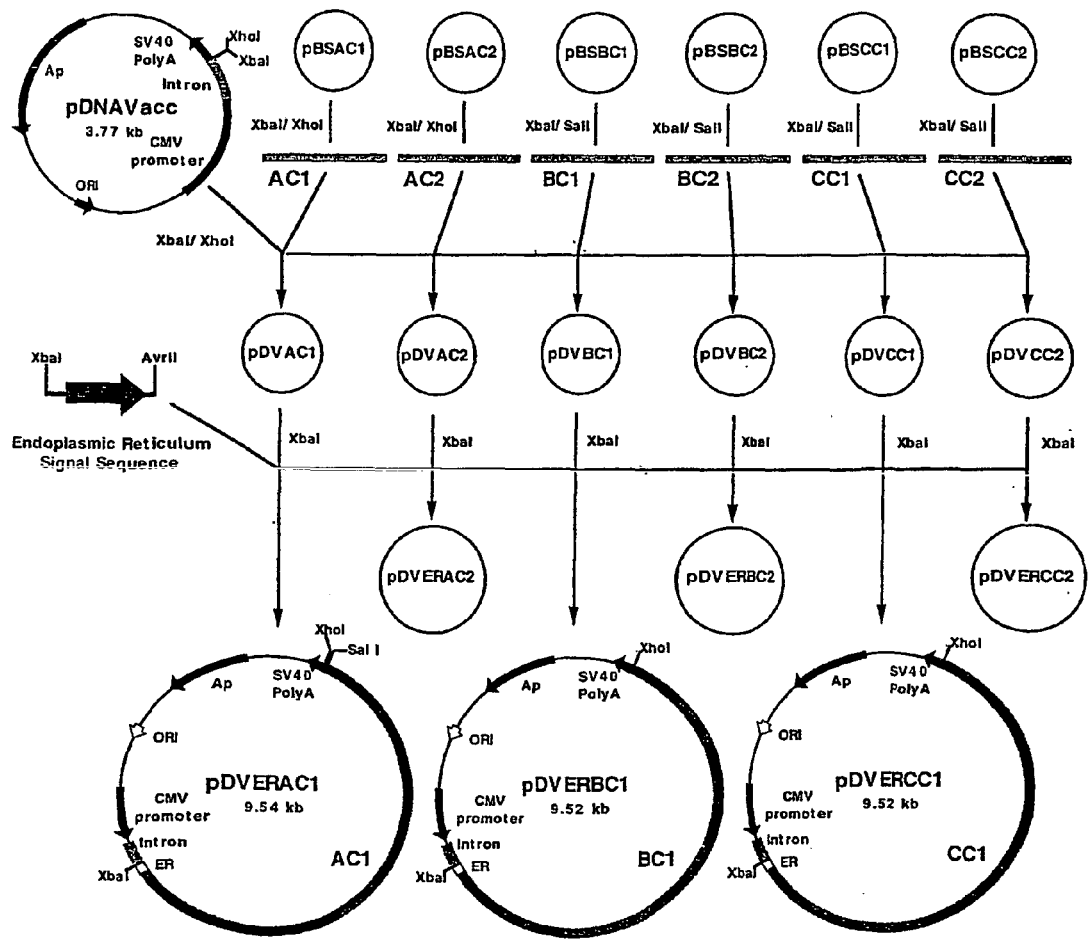

DNA Vaccination plasmids were constructed by excising the cassettes from the selected plasmid clones with XbaI/XhoI (cassette A) or XbaI/SalI (cassettes B and C) and ligating them into pDNAVacc cut with XbaI/XhoI to create pDVAC1, pDVAC2, pDVBC1, pDVBC2, pDVCC1, pDVCC2, respectively (FIG. 18a). These plasmids were then further modified by cloning into their XbaI site a DNA fragment excised using XbaI/AvrII from pTUMERA2 and encoding a synthetic endoplasmic reticulum (ER) signal sequence from the Adenovirus E1A protein (Persson et al., 1980) (FIG. 18a). ER signal sequences have been shown previously to enhance the presentation of both CTL and T helper epitopes in vivo (Ishioka, G.Y., 1999; Thomson et al., 1998). The plasmids pDVERAC1, pDVERBC1, pDVERCC1 andpDVERAC2, pDVERBC2, pDVERCC2 were then mixed together to create, plasmid pool 1 and pool 2 respectively. Each plasmid pool collectively encodes one copy of the designed full-length HIV Savine.

Figure 18B:
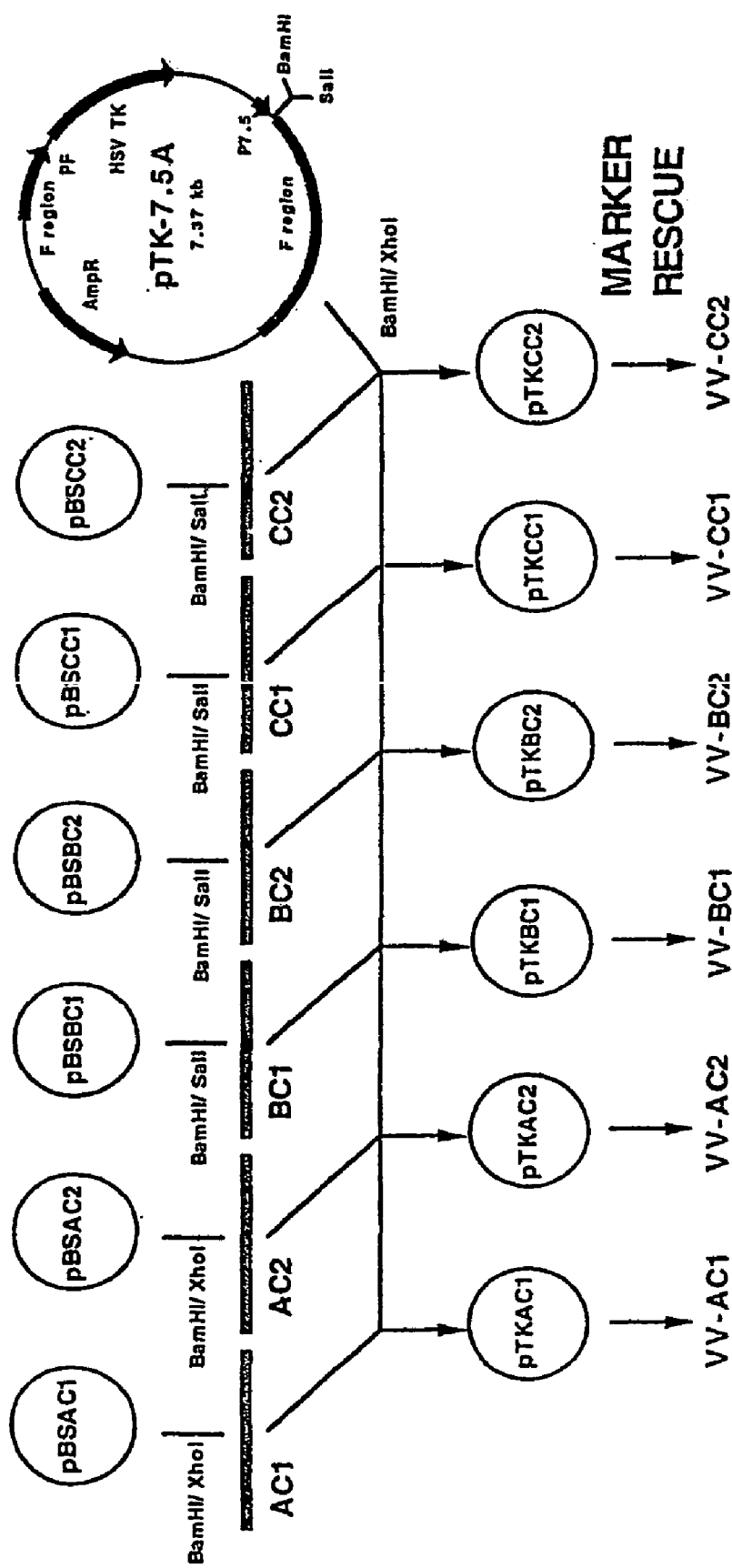

Plasmids to generate recombinant Vaccinia viruses which express HIV Savine sequences were constructed by excising the various HIV Savine cassettes from the selected plasmid clones using BamHI/XhoI (cassette A) or BamHI/SalI (cassettes B and C) and cloned into the marker rescue plasmid, pTK7.5, cleaved with BamHI/SalI. These pTK7.5-derived plasmids were then used to generate recombinant Vaccinia viruses by marker rescue recombination using established protocols (Boyle et al., 1985) to generate VV-AC1, VV-AC2, VV-BC1, VV-BC2, VV-CC1 and VV-CC2 (FIG. 18b).

Figure 18C:
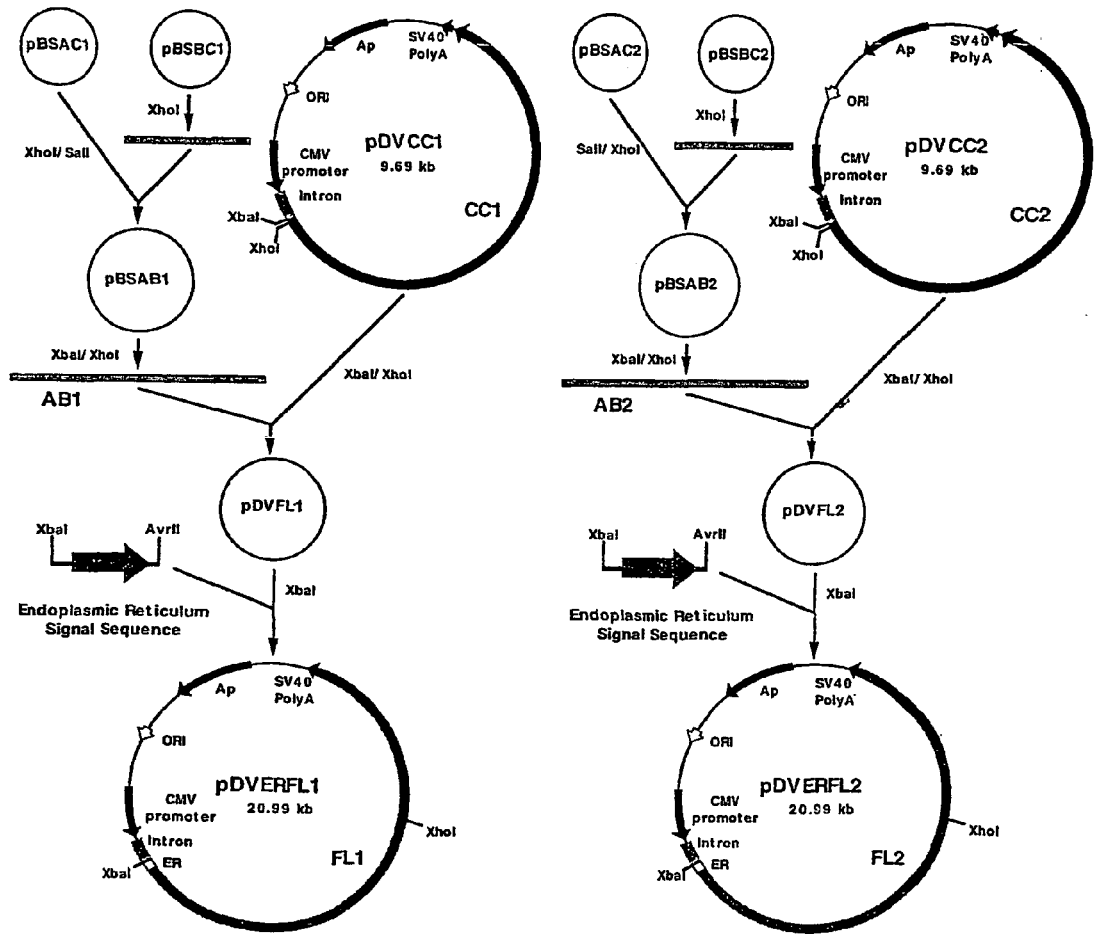

Two further DNA vaccine plasmids were constructed each encoding a version of the full length HIV Savine (FIG. 18c). Briefly, the two versions of cassette B were excised with )XhoI and cloned into the corresponding selected plasmid clones containing cassette A sequences that were cut with XhoI/SalI to generate pBSAB 1 and pBSAB2 respectively. The joined A/B cassettes in pBSAB 1 and pBSAB2 were excised with XbaI/XhoI and cloned into pDVCC1 and pDVCC2, respectively, and cleaved with XbaI/XhoI to generate pDVFL1 and pDVFL2. These were then further modified to contain an ER signal sequence using the same cloning strategy as outlined in FIG. 18a.

Restimulation of HIV specific lymphocytes from HIV infected patients

Figure 19:
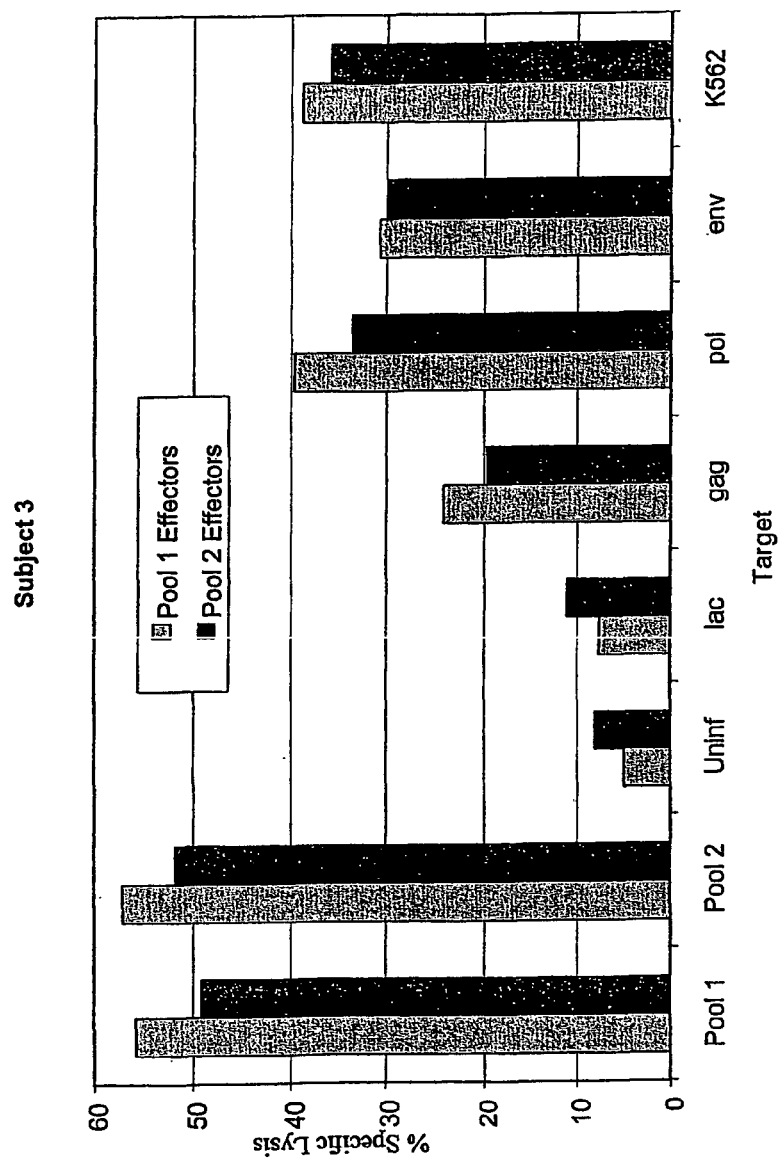

The present inventors examined the capacity of the HIV Savine to restimulate HIV-specific polyclonal CTL responses from HIV-infected patients. PBMCs from three different patients were restimulated in vitro with two HIV Savine Vaccinia virus pools (Pool 1 included VV-AC1 andVV-BC1; Pool 2 included VV-AC2, VV-BC2 and VV-CC2) then used in CTL lysis assays against LCLs infected either with one of the Savine Vaccinia virus pools or Vaccinia viruses which express gag, env or pol. FIG. 19 clearly shows, that in all three assays, both HIV Savine viral pools restimulated HIV-specific CTL responses which could recognise targets expressing whole natural HIV antigens and not targets which were uninfected or infected with the control Vaccinia virus. Furthermore, in all three cases, both pools restimulated responses that recognized all three natural HIV antigens. This result suggests that the combined Savine constructs will provide broader immunological coverage than single antigen based vaccine approaches. The level of lysis in each case of targets infected with Savine viral pools was significantly higher than the lysis recorded for any other infected target. This probably reflects the combined CTL responses to gag, pol, and env plus other HIV antigens not analyzed here but whose sequences are also incorporated into the Savine constructs.

CTL recognition of each HIV antigen is largely controlled by each patient's HLA background hence the pattern of CTL lysis for whole HIV antigens is different in each patient. Interestingly, this CTL lysis pattern did not change when the second Savine Vaccinia virus pool was used for CTL restimulation. In these assays, therefore, the inventors were unable to demonstrate clear differences between pools 1 and 2, despite pool 1 lacking a Vaccinia virus expressing cassette CC1 and despite the many amino acid differences between the A and B cassettes in each pool (see table 1).

From the foregoing, the present inventors have developed a novel vaccine/therapeutic strategy. In one embodiment, pathogen or cancer protein sequences are systemically fragmented, reverse translated back into DNA, rearranged randomly then joined back together. The designed synthetic DNA sequence is then constructed using long oligonucleotides and can be transferred into a range of delivery vectors. The vaccine vectors used here were DNA vaccine plasmids and recombinant poxvirus vectors which have been previously shown to elicit strong T cell responses when used together in a 'prime-boost' protocol (Kent et al., 1997). An important advantage of scrambled antigen vaccines or 'Savines' is that the amount of starting sequence information for the design can be easily expanded to include the majority of the protein sequences from a pathogen or for cancer, thereby providing the maximum possible vaccine or therapy coverage for a given population.

An embodiment of the systematic fragmentation approach described herein was based on the size and processing requirements for T cell epitopes and was designed to cause maximal disruption to the structure and function of protein sequences. This fragmentation approach ensures that the maximum possible range of T cell epitopes will be present from any incorporated protein sequence without the protein being functional and able to compromise vaccine safety Another important advantage of Savines is that consensus protein sequences can be used for their design. This feature is only applicable when the design needs to cater for pathogen or cancer antigens whose sequence varies considerably. HIV is a highly mutagenic virus, hence this feature was utilized extensively to design a vaccine which has the potential to cover not only field isolates of HIV but also the major HIV clades involved in the current HIV pandemic. To construct the HIV Savine, one set of losynthesizedleotides was synthesized, which included degenerate bases in such a way that 8 constructs are theoretically required for the vaccine to contain all combinations in any stretch of 9 amino acids. The inventors believe that this approach can be improved for the following reasons: 1) While degenerate bases should be theoretically equally represented, in practice some degenerate bases were biased towards one base or the other, leading to a lower than expected frequency of the designed mutations in the two full length HIV Savines which were constructed (see Table 1). 2) Only sequence combinations actually present in the HIV lade consensus sequences are required to get full clade coverage, hence the number of full length constructs needed could be reduced. To reduce the number of constructs however, separate sets of long oligonucleotides would have to be synthesized, significantly increasing the cost, time and effort required to generate a vaccine capable of such considerable vaccine coverage.

A significant problem during the construction of the HIV Savine synthetic DNA sequence was the incorporation of non-designed mutations. The most serious types of mutations were insertions, deletions or those giving rise to stop codons, all of which change the frame of the synthesized sequences and/or caused premature truncation of the Savine proteins. These types of mutation were removed during construction of the HIV Savines by sequencing multiple clones after subcassette and cassette construction and selecting functional clones. The major source of these non-designed mutations was in the long oligonucleotides used for Savine synthesis, despite their gel purification. This problem could be reduced by making the initial subcassettes smaller thereby reducing the possibility of corrupted oligonucleotides being incorporated into each subcassette clone. The second major cause of non-designed mutations was the large number of PCR cycles required for the PCR and ligation-mediated joining of the subcassettes. Including extra sequencing and clone selection steps during the subcassette joining process should help to reduce the frequency of non-designed mutations in future constructs. Finally, another method that could help reduce the frequency of such mutations at all stages is to use resolvase treatment. Resolvases are bacteriophage-encoded endonucleases which recognise disruptions to double stranded DNA and are primarily used by bacteriophages to resolve Holliday junctions (Mizuuchi, 1982; Youil et al., 1995). T7 endonuclease I has already been used by the present inventors in synthetic DNA constructions to recognise mutations and cleave corrupted dsDNA to allow gel purification of correct sequences. Cleavage of corrupted sequences occurs because after a simple denaturing and hybridization step mutated DNA hybridizes to correct DNA sequences and results in a mispairing of DNA bases which is able to be recognized by the resolvase. This method resulted in a 50% reduction in the frequency of errors. Further optimization of this method and the use of a thermostable version of this type of enzyme could further reduce the frequency of errors during long Savine construction.

Figure 20:
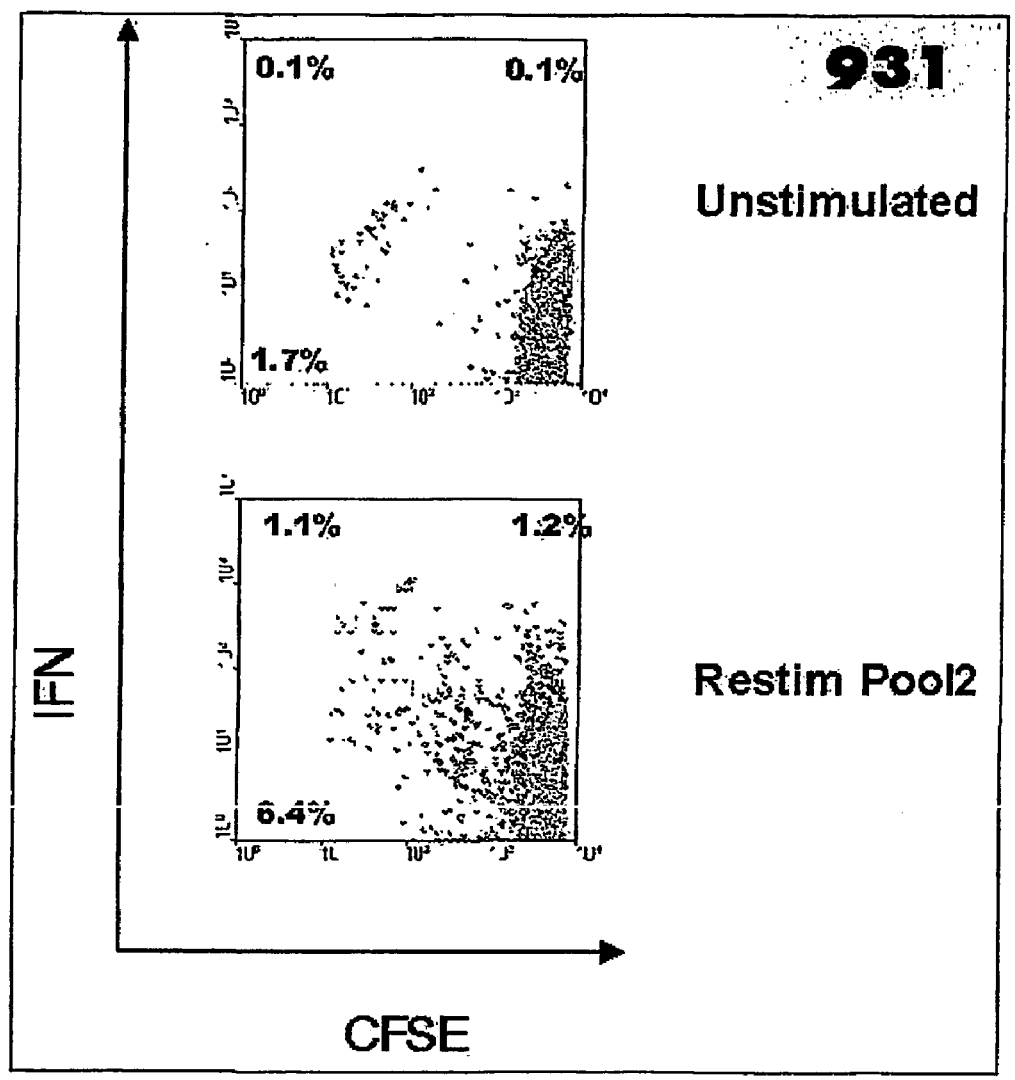
FIG. 20 is a diagrammatic representation showing CD4+ proliferation of PBMCs from HIV-1 infected patients restimulated with either Pool1 or Pool2 of the HIV-1 Savine. Briefly PBMCs were stained with CFSE and culture for 6 days with or without VVs encoding either pooh or pool2 of the HIV-1 Savine. Restimulated Cells were then labelled with antibodies and analysed by FACS.

Two pools of Vaccinia viruses expressing Savine cassettes were both shown to restimulate HIV-specific responses from three different patients infected with B lade HIV viruses. These results provide a clear indication that the HIV Savine should provide broad coverage of the population because each patient had a different HLA pattern yet both pools were able to restimulate HIV-specific CTL responses in all three patients against all three natural HIV proteins tested. Also, both pools were shown to restimulate virtually identical CTL patterns in all three patients. This result was unexpected because some responses should have been lost or gained due to the amino acid differences between the two pools and because Pool 1 is only capable of expressing ⅔ of the full length HIV Savine. There are two suggested reasons why the pattern of CTL lysis was not altered between the two viral pools. Firstly, the sequences in the Savine constructs are nearly all duplicated because the fragment sequences overlap. Hence the loss of a third of the Savine may not have excluded sufficient T cell epitopes for differences to be detected in only three patient samples against only three HIV proteins. Secondly, while mutations often destroy T cell epitopes, if they remain functional, then the CTL they generate frequently can recognise alternate epitope sequences. Taken together this finding indirectly suggests that combining only two Savine constructs may provide robust multiclade coverage. Further experiments are being carried out to directly examine the capacity of the HIV Savine to stimulate CTL generated by different strains of HIV virus. The capacity of the two HIV-1 Savine Vaccinia vector pools to stimulate CD4+ T cell HIV-1 specific responses from infected patients was also tested (FIG. 20). Both patients showed significant proliferation of CD4+ T cells although both pools did not show consistent patterns suggesting that the two pools may provide wider vaccine coverage than using either pool independently.

Figure 21:
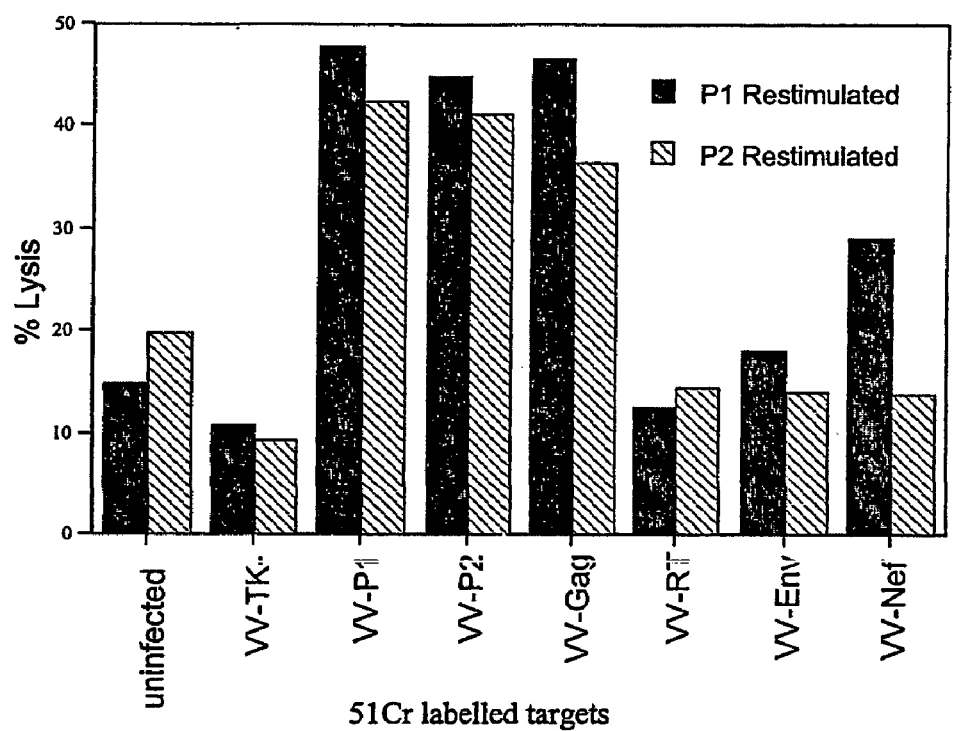
FIG. 21 is a graphical representation showing the CTL response in mice vaccinated with the HIV Savine. C57BL6 mice were immunised with the HIV-1 Savine DNA vaccine comprising the six plasmids described in FIG. 18a (100 μg total DNA was given as 50 μg/leg i.m.). One week later Poxviruses (1×10$^7$ pfu) comprising Pool 1 of the HIV-1 Savine were used to boost the immune responses. Three weeks later splenocytes from these mice were restimulated with VV-Pool 1 or VV-Pool 2 for 5 days and the resultant effectors used in a $^{51}$Cr release cytotoxicity assay against targets infected with CTRVV, VV-pools or VV expressing the natural antigens from HIV-1.

The present inventors have generated a novel vaccine strategy, which has been used to generate what the inventors believe to be the most effective HIV candidate vaccine to date. The inventors have used this vaccine to immunize naive mice. FIG. 21 shows conclusively that the HIV-1 Savine described above can generate a Gag and Nef CTL response in naive mice. It should be noted, however, that the Nef CTL epitope appeared to exist only in Pool 1 since it was not restimulated by Pool 2. This is further proof of the utility of combining HIV-1 Savine Pool 1 and Pool 2 components together to provide broader vaccine coverage.

Figure 22A:
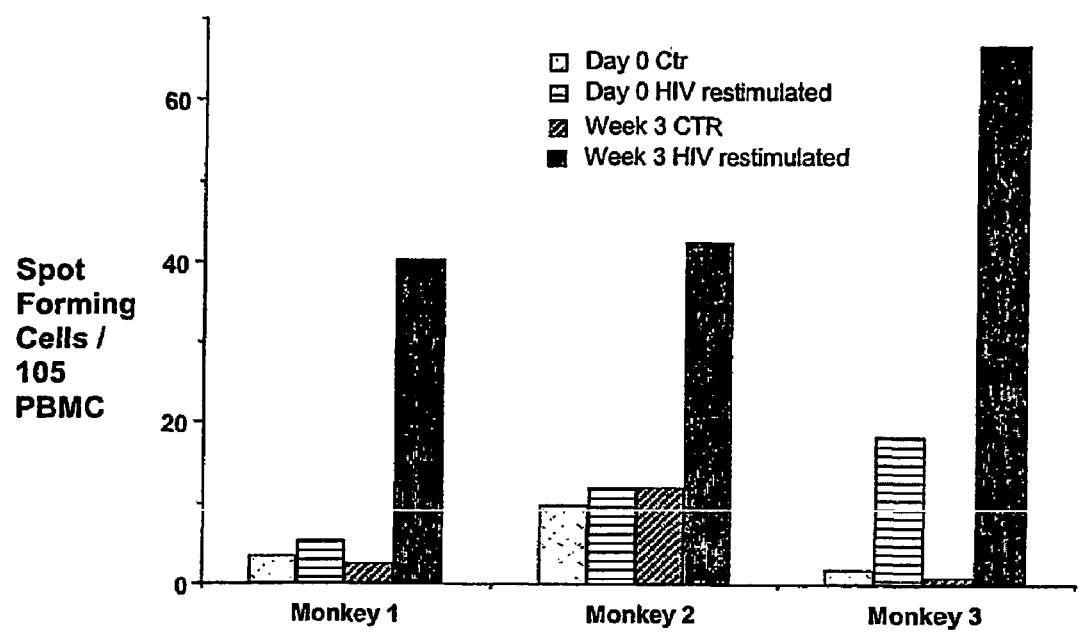
FIG. 22 shows immune responses of HIV Immune Macaques (vaccinated with recombinant FPV expressing gag-pol and challenged with HIV-1 2 years prior to experiment). Monkeys 1 and 2 were immunised once at day 0 with VV Savine pool 1 (Three VVs which together express the entire HIV Savine). Monkey 3 was immunised twice with FPV-gag-pol ie., Day 0 is 3 weeks after first FPV-gag-pol immunisation. A) IFN-γ detection by ELISPOT of whole blood (0.5 mL, venous blood heparin-anticoagulated) stimulated with Aldrithiol-2 inactivated whole HIV-1 (20 hours, 20 μg/mL). Plasma samples were then centrifuged (1000×g) and assayed in duplicate for antigen-specific IFN using capture ELISA. B) Flow cytometric detection of HIV-1 specific CD69+/CD8+ T cells. Freshly isolated PBMCs were stimulated with inactivated HIV-1 as above for 16 hours, washed and labelled with the antibodies. Cells were then analysed using a FACScalibur™ flow cytometer and data. analysed using Cell-Quest software. C) Flow cytometric detection of HIV-1 specific CD69+/CD4+ T cells carried out as in B).
Figure 22B:
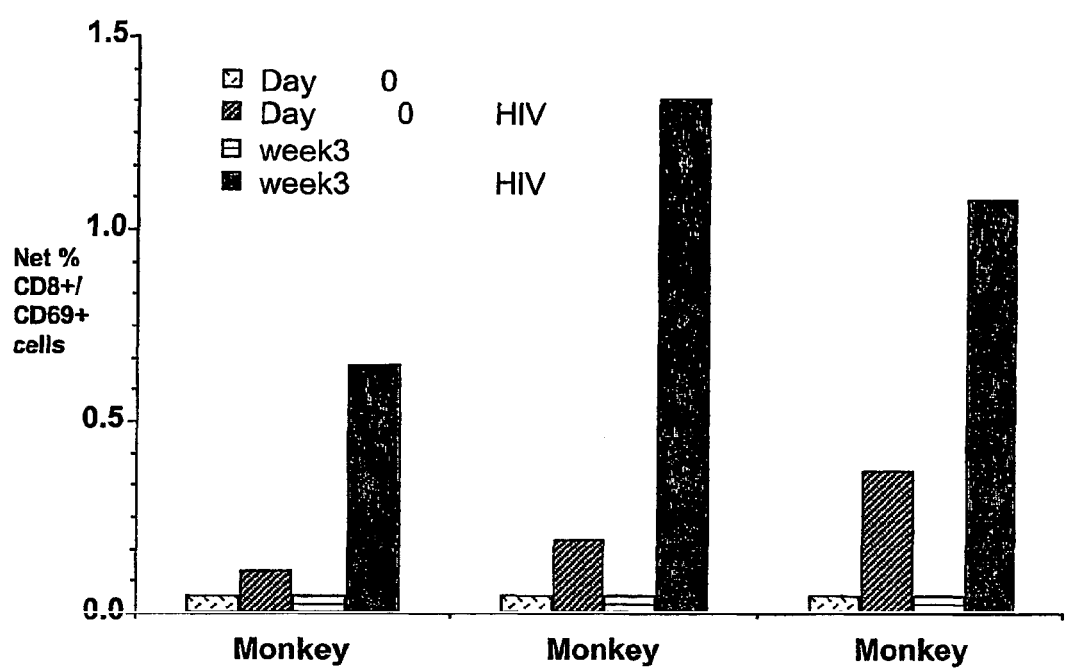
Figure 22C:
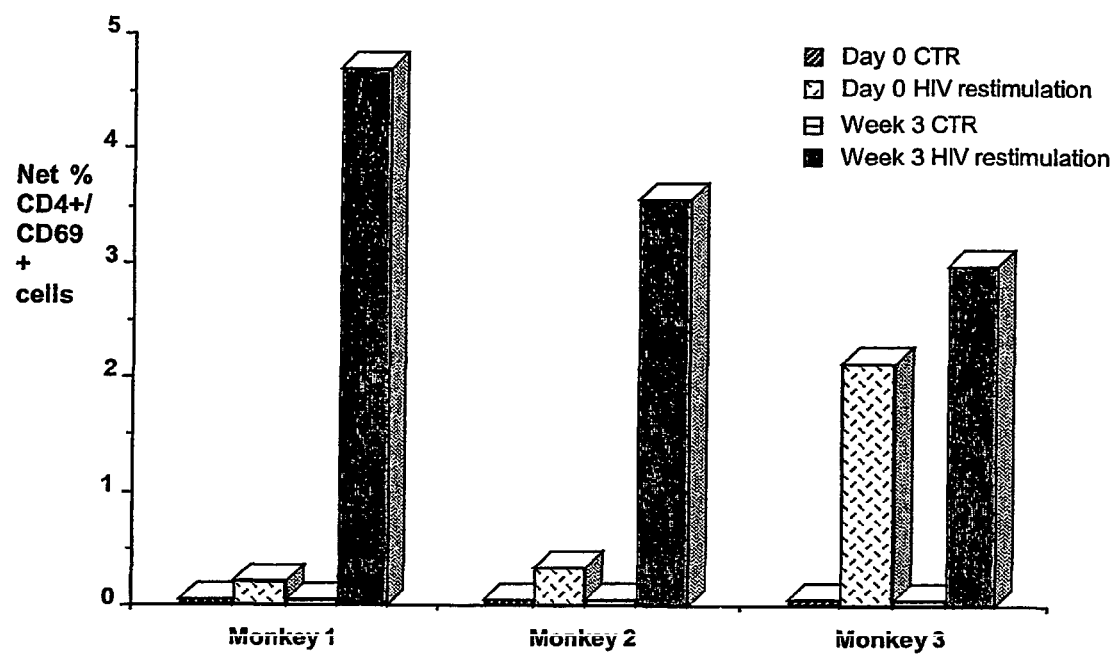

The HIV-1 Savine Vaccinia vectors have also been used to restimulate in vivo HIV-1 responses in pre-immune *M. nemestrina* monkeys. These experiments (FIG. 22) showed, by INF-γ ELISPOT and CD69 expression on both CD4 and CD8 T cells, that the ability of the HIV-1 SAVINE to restimulate HIV-1 specific responses in vivo is equivalent or perhaps better than another HIV-1 candidate vaccine.

This is a generic strategy able to be applied to many other human infections or cancers where T-cell responses are considered to be important for protection or recovery. With this in mind the inventors have begun constructing Savines for melanoma, cervical cancer and Hepatitis C. In the case of melanoma, the majority of the currently identified melanoma antigens have been divided into two groups, one containing antigens associated with melanoma and one containing differentiation antigens from melanocytes, which are often upregulated in melanomas. Two Savine constructs are presently being constructed to cater for these two groups. The reason for making the distinction is that treatment of melanoma might first proceed using the Savine that incorporates fragments of melanoma specific antigens only. If this Savine fails to control some metastases then the less specific Savine containing the melanocyte-specific antigens can then be used. It is important to point out that other cancers also express many of the antigens specific to melanomas e.g., testicular and breast cancers. Hence the melanoma specific Savine may have therapeutic benefits for other cancers.

A small Savine is also being constructed for cervical cancer. This Savine will contain two antigens, E6 and E7, from two strains of human papilloma virus (HPV), HPV-16 and HPV-18, directly linked with causing the majority of cervical cancers worldwide. There is a large number of sequence differences in these two antigens between the two strains which would normally require two Savines to be constructed. However since this Savine is small, the antigen fragments from both strains are being scrambled together. While it is normally better for the Savine approach to include all or a majority of the antigens from a virus, in this case only E6 and E7 are expressed during viral latency or in cervical carcinomas. Hence in the interests of simplicity, the rest of the HPV genome will not be included although all HPV antigens would be desirable in a Savine against genital warts.

Two Savines have also been constructed for two strains of hepatitis C, a major cause of liver disease in the world. Hepatitis C is similar to HIV in the requirements for a vaccine or therapeutic. However, the major hepatitis C strains share significantly lower homology, 69-79%, with one another than do the various HIV clades. To cater for this the inventors have decided to construct two separate constructs to cater for the two major strains present in Australia, types 1a and 3a, which together cause approximately 80-95% of hepatitis C infections in this country. Both constructs will be approximately the same size as the HIV Savine but will be blended together into a single vaccine or therapy.

Overall it is believed that the Savine vaccine strategy is a generic technology likely to be applied to a wide range of human diseases. It is also believed that because it is not necessary to characterize each antigen, this technology will be actively applied to animal vaccines as well where research into vaccines or therapies is often inhibited by the lack of specific reagents, modest research budgets and poor returns on animal vaccines.

Example 2

Hepatitis C Savine

Synthetic immunomodulatory molecules have also been designed for treating Hepatitis C. In one example, the algorithm of FIG. 25 was applied to a consensus polyprotein sequence of Hepatitis C1a to facilitate its segmentation into overlapping segments (30 aa segments overlapping by 15aa), the rearrangement of these segments into a scrambled order and the output of Savine nucleic acid and amino acid sequences, as shown in FIG. 26. Exemplary DNA cassettes (A, B and C) are also shown in FIG. 26, which contain suitable restriction enzyme sites at their ends to facilitate their joining into a single expressible open reading frame.

Example 3

Melanonia Savine

The algorithm of FIG. 25 was also applied to melanocyte differentiation antigens (gp100, MART, TRP-1, Tyros, Trp-2, MC1R, MUC1F and MUC1R) and to melanoma specific antigens (BAGE, GAGE-1, gp100In4, MAGE-1, MAGE-3, PRAME, TRP2IN2, NYNSO1a, NYNSO1b and LAGE1), as shown in FIG. 27, to provide separate Savine nucleic acid and amino acid sequences for treating or preventing melanoma.

Example 4

Resolvase Repair Experiment

A resolvase can be used advantageously to repair errors in polynucleotides. The following procedure outlines resolvase repair of a synthetic 340 bp fragment in which DNA errors were common.

Method

The 340 bp fragment was PCR amplified and gel purified on a 4% agarose gel. After spin purifying, 10 ul of the eluate corresponding to approximately 100 ng was subjected to the resolvase repair treatment. The rest of the DNA sample was stored for later cloning as the untreated control.

2 μL of 10×PCR buffer, 2 μL of 20 MM $MgCl_2$ and 6 μL of MilliQ™ water (MQW) and Taq DNA polymerase were added to the 10 μL DNA sample. The mixture was subjected to the following thermal profile; 95° C. for 5 min, 65° C. for 30 min, cooled and held at 37° C. Five μL of 10×T7 endonuclease I buffer, 8 μL of 1/50 μL of T7endoI enzyme stock and 17 μL of MQW were added, mixed and incubated for 30 min. Loading buffer was added to the sample and the sample was electrophoresed on a 4% agarose gel. A faint band corresponding to the full length fragment was excised and subjected to 15 further cycles of PCR. The amplified fragment was agarose gel purified and, along with the untreated DNA sample, cloned into pBluescript. Eleven plasmid clones for each DNA sample were sequenced and the number and type of errors compared (see table) Buffers were as follows:

10×T7Endonuclease Buffer 2.5 ml 1M TRIS pH7.8, 0.5 ml 1M MgCl$_2$, 25 µL 1 M DTT, 50 µL 10 mg/mL BSA, 2 mL MQW made up to a total of 5 mL.

T7 Endonuclease I Stock

Concentrated sample of enzyme prepared by, and obtained from, Jeff Babon (St Vincent's Hospital) was diluted 1/50 using the following dilution buffer: 50 µL 1 M TRIS pH7.8, 0.1 µL 1M EDTA pH8, 5 µL 100 mM glutathione, 50 µL 10 mg/mL BSA, 2.3 mL MQW, 2.5 mL glycerol made up to a total of 5 mL.

Results

The results are summarized in Tables 2 and 3.

TABLE 2

Total Errors

| Untreated | Resolvase treated |
|---|---|
| A/T to G/C = 6 | A/T to G/C = 1 |
| G/C to A/T = 12 | G/C to A/T = 7 |
| A/T to deletion = 1 | A/T to deletion = 1 |
| G/C to deletion = 6 | G/C to deletion = 3 |

TABLE 3

Clone Summary

| Untreated | Resolvase treated |
|---|---|
| 6/11 contained deletions | 3/11 contained deletions |
| 9/11 contained mutations | 7/11 contained mutations |
| 2/11 correct | 3/11 correct |

DISCUSSION/CONCLUSION

While overall the number of correct clones obtained was not significantly different, there was a significant difference in the level of errors. This reduction in errors becomes more significant as greater numbers of long oligonucleotides are joined into the one construct i.e., increasing the difference between untreated versus treated samples in the chance of obtaining a correct clone. It is believed that combining another resolvase such as T4 endonuclease VII may further enhance repair or increase the bias against errors.

Importantly, this experiment was not optimized e.g., by using proofreading PCR enzymes or optimized conditions. Finally if the repair reaction is carried out during normal PCR, for example, by including a thermostable resolvase, it is believed that amplification of already damaged long oligonucleotides, and the normal accumulation of PCR induced errors, even using error reading polymerases during PCR, could be reduced significantly. The repair of damaged long oligonucleotides is particularly important for synthesis of long DNA fragment such as in Savines because, while the rate of long oligonucleotide damage is typically <5%, after joining 10 oligonucleotides, the error rate approaches 50%. This is true even using the best proofreading PCR enzymes because these enzymes do not verify the sequence integrity using correct oligonucleotide templates that exist as a significant majority (95%) in a joining reaction.

The disclosure of every patent, patent application, and publication cited herein is incorporated herein by reference in its entirety.

The citation of any reference herein should not be construed as an admission that such reference is available as "Prior Art" to the instant application Throughout the specification the aim has been to describe the preferred embodiments of the invention without limiting the invention to any one embodiment or specific collection of features. Those of skill in the art will therefore appreciate that, in light of the instant disclosure, various modifications and changes can be made in the particular embodiments exemplified without departing from the scope of the present invention. All such modifications and changes are intended to be included within the scope of the appended claims.

BIBLIOGRAPHY

Ada G. L.:Vaccines. In: Paul, W E, Fundamental Immunology, 3rd edition, Raven Press, Ltd, New York 1993,:1309-1352.

Boyle D. B., Coupar B. E. H., Both G. W.: Multiple-cloning-site plasmids for the rapid construction of recombinant poxviruses. Gene 1985,35:169-177.

Brown J. H., Jardetsky T. S., Gorga J. C., Stern L. J., Urban R. G., Strominger J. L., Wiley D. C.: Three-dimensional structure of the human class II histocompatibility antigen HLA-DR1. Nature 1993, 364:33-39.

Chicz, R. M., Urban, R. G., Gorga, J. C., Vignali, D. A. A., Lane, W. S. and Strominger, J. L., Specificity and promiscuity among naturally processed peptides bound to HLA-DR alleles., J. Exp. Med., 178, 27-47 (1993).

Del Val M., Schlicht H., Ruppert T., Reddehase M. J., Koszinowski U. H.: Efficient processing of an antigenic sequence for presentation by MHC class I molecules depends on its neighboring residues in the protein. Cell 1991, 66:1145-1153.

Dyall, R., Vasovic, L. V., Molano, A. and Nikolic-Zugic, J., CD4-independent in vivo priming of murine CTL by optimal MHC class I-restricted peptides derived from intracellular pathogens., Int. Immunol., 7(8), 1205-1212 (1995).

Fremont, D. H., Matsumura, M., Stura, E. A., Peterson, P. A. and Wilson, I. A., Crystalstructures of two viral peptides in complex with murine MHC class IH-2K$^b$., Science, 257, 919-927 (1992).

Gao, F., Robertson, D. L., Morrison, S. G., Hui, H., Craig, S., Fultz, P. N., Decker, J., Girard, M., Shaw, G. M., Hahn, B. H., and Sharp, P. m. "The heterosexual HIV-1 epidernic in Thailand is caused by an intersubtype (A/E) recombinant of African origin. J. Virology, (1996)

Goulder P. J. R., Sewell, A. K., Lalloo, D. G., Price, D. A., Whelan, J. A., Evans, J., Taylor, G. P., Luzzi, G., Giangrande, P., Phillips, R. E., McMichael, A. J. "Patterns of immunodominance in HIV-1-specific cytotoxic T lymphocyte responses in two human histocompatibility leukocyte antigens (HLA)-identical siblings with HLA-A*0201 are influenced by epitope mutation" (1997) J. Exp. Med. 185 (8), 1423-1433.

HIV Molecular Immunology Database 1997 Editors Bette Korber, John Moore, Cristian Brander, Richard Koup, Barton Haynes and Bruce Walker Publisher, Los Alamos National Laboratory, Theoretical Biology and Biophysics, Los Alamos, N.Mex., Pub LAUR 98-485

Ishioka, G. Y. et al. "Utilization of MHC class I transgenic mice for development of minigene DNA vaccines encoding multiple HLA-restricted CTL epitopes" (1999) J. Immunol. 162, 3915-3925

Kent S. J. Zhao, A. Best, S. J. Chandler, J. D., Boyle, D. B., Ramshaw, I. A. "Enhanced T-cell immunogenicity and protective efficacy of a human immunodeficiency virus Type 1 vaccine regimen consisting of consecutive priming with DNA and boosting with recombinant fowlpox virus. (1998) J. Virol. &2(12), 10180-10188.

Kwong P. D., et al "Structure of an HIV gp120envelope glycoprotein in complex with the CD4 receptor and a human antibody" (1998) Nature 393, 648-659.

Mizuuchi, K., "T4 endonuclease VII cleaves Holliday structures" (1982) Cell 29, 357-365.

Newcomb, J. R. and Cresswell, P., Characterization of endogenous peptides bound to purified HLA-DR molecules and their absence from invariant chain-associated αβ dimers., J. Immunol.,150(2), 499-507 (1993).

Ogg G. S. et al "Quantitation of HIV-1-specificcytotoxic T lymphocytes and plasma Jardetzky, T. S., Lane, W. S., Robinson, R. A., Madden, D. R., Wiley, D. C., Identification of self load of viral RNA" (1998) Science 279, 2103-2106.peptides bound to purified HLA-B27., Nature, 353, 326-329 (1991).

Parmiani G. "Future perspective's in specific immunotherapy of melanoma" 1998 Euro. J. Cancer 34(supp3), S42-S47.

Persson H., Jörnvall H., Zabielski J.: Multiple mRNA species for the precursor to an adenovirus-encoded glycoprotein: Identification and structure of the signal sequence. Proc Natl Acad Sci 1980, 77:6349-6353.

Rötzschke, O., Falk, K., Deres, K., Schild, H., Norda, M., Metzger, J., Jung, G. and Rammensee, H., Isolation and analysis of naturally processed viral peptides as recognized by cytotoxic T cells., Nature, 348, 252-254 (1990).

Rowland-Jones S., et al "HIV-specific cytotoxic T cells in HIV-exposed but uninfected Gambian women" (1995) Nat. Med. 1(1), 59-64.

Rowland-Jones S. L. et al "Cytotoxic T cell responses to multiple conserved HIV epitopes in HIV-resistant prostitutes in Nairobi" (1998) J. Clin. Invest. 102(9), 1758-1765.

Salminen, M. O., Johansson, B., Sonnerborg, A., Ayehunie, S., Gotte, D., Leinikki, P. Burke, D. S., McCutchan, F. E., "Full-length sequence of an Ethiopian human immunodeficiency virus type 1 (HIV-1) isolate of genetic subtype C." (1996) AIDS Res. Hum. Retroviruses 12(14), 1329-1339.

Sandhu, G. S., Aleff, R. A., and Kline, B. C. "Dual assymetric PCR: One-step construction of synthetic genes" (1992) Biotechniques 12(1), 14-16.

Thomson, S. A. et al "Minimal epitopes expressed in a recombinant 'polyepitope' protein are processed and presented to $CD8^+$ cytotoxic T cells: Implications for vaccine design." Proc. Natl. Acad. Sci., 92, 5845-5849 (1995).

Thomson, S. A. et al "Recombinant polyepitope vaccines for the delivery of multiple CD8 cytotoxic T cell epitopes." J. Immunol., 157(2), 822-826 (1996).

Thomson, S. A. et al "Delivery of multiple CD8 cytotoxic T cell epitopes by DNA vaccination." J. Immunol., 160, 1717-1723(1998).

Thomson, S. A. et al "Targeting a polypitope protein incorporating multiple class II-restricted viral epitopes to the secretory/endocytic pathway facilitates immune recognition by $CD4^+$ cytotoxic T lymphocytes: A novel approach to vaccine design." J. Virol., 72(3), 2246-2252 (1998)

Townsend A. R. M., Rothbard J., Gotch F. M., Bahadur G., Wraith D., McMichael A. J.: The epitopes of influenza nucleoprotein recognized by cytotoxic T lymphocytes can be defined with short synthetic peptides. Cell 1986, 44:959-968.

Woodberry, T., Gardner, J., Mateo, L., Eisen, D., Medvecsky, J., Ramshaw, I. A., Thomson, S. A., Ffrench, R. A., Elliott, S. L., Firat, H., Lemonnier, F. A., Suhrbier, A. "Immunogenicity of an HIV polytope vaccine containing multiple HLA-A2 HIV CD8+ cytotoxic T cell epitopes" J. Virol. 73(7), 5320-5325 (1999)

Youil, R., Kemper, B. W., Cotton, R. G. H. "Screening for mutations by enzyme mismatch cleavage with T4 endonuclease VII" (1995) Proc. Natl. Acad. Sci. 92, 87-91.

SEQUENCE LISTING (1507 sequences)

SEQ ID NO: 1 - protein, 499 aa, Artificial
  GAG consensus polypeptide
MGARASVLSGGKLDAWEKIRLRPGGKKKYKMKHLVWASRELERFALNPGLLETAEGCQQILEQLQSALKTGSEELKSLYNTIATLWCVHQRIEVKDTKEALDKIEEEQKKSQQKTQQAAADTGSSSKVSQNYPIVQNAQGQMVHQPLSPRTLNAWVKVIEEKGFNPEVIPMFSALSEGATPQDLNMMLNIVGGHQAAMQMLKETINEEAAEWDRVHPVHAGPIPPGQMREPRGSDIAGTTSTLQEQIGWMTNNPPIPVGDIYKRWIILGLNKIVRMYQPVSILDIRQGPKEPFRDYVDRFYKTLRAEQATQEVKNWMTETLLVQNANPDCKSILKALGTGATLEEMMTACQGVGGPSHKARVLAEAMSQATHANIMMQRGNFKGQKRIIKCFNCGKEGHLARNCRAPRKKGCWKCGKEGHQMKDCTERQANFLGKIWPSNKGRPGNFPQSKPEPTAPPAENFGFGEETTPSPKQEQKDKEHYPPSASLKSLFGNDPLSQ

SEQ ID NO: 2 - protein, 995 aa, Artificial
  POL consensus polypeptide
FFRENLAFQQGKAREFSSEQTGANSSASRKLGDGGGAERQGTSSSFSFPQITLWQRPLVTIKIGGQLKEALLDTGADDTVLEDINLPGKWKPKMIGGIGGFIKVRQYDQILIEICGKKAIGTVLVGPTPVNIIGRNMLTQIGCTLNFPISPIDTVPVKLKPGMDGPKVKQWPLTEEKIKALTEICKEMEEEGKISKIGPENPYNTPVFAIKKKDSTKWRKLVDFRELNKRTQDFWEVQLGIPHPAGLKKKKSVTVLDVGDAYFSVPLDESFRKYTAFTIPSINNETPGIRYQYNVLPQGWKGSPAIFQSSMTKILEPFRIKNPEMVIYQYMDDLYVGSDLEIGQHRTKIEELRAHLLRWGFTTPDKKHQKEPPFLWMGYELHPDRWTVQPIELPEKDSWTVNDIQKLVGKLNWASQIYAGIKVKQLCKLLRGTKALTDIVPLTEEAELELEENREILREPVHGVYYDPSKDLVAEVQKQGQDQWTYQIYQEPFKNLKTGKYSRKRSAHTNDVRQLTEVVQKIATESIVIWGKTPKFRLPIQRETWETWWMEYWQATWIPEWEFVNTPPLVKLWYQLEKDPIVGAETFYVDGAASRETKLGKAGYVTDRGRQKVISLTETTNQKTELHAIHLALQDSGSEVNIVTDSQYALGIIQAQPDRSESEVVSQIIEELIKKEKVYLSWVPAHKGIGGNEQVDKLVISGIRKVLFLDGINKAQEEHERYHSNWRTMASDFNLPPIVAKEIVANCDKCQLKGEAMHGQVDCSPGIWQLDCTHLEGKVILVAVHVASGYIEAEVIPAETGQETAYFLLKLAGRWPVKVIHTDNGSNFTSAAVKAACWWANIKQEFGIPYNPQSQGVVESMNKELKKIIGQVREQAEHLKTAVQMAVFIHNFKRKGGIGGYSAGERIIDIIATDIQTKELQKQITKIQNFRVYYRDSRDPIWKGPAKLLWKGEGAVVIQDNSDIKVVPRRKAKIIRDYGKQMAGDDCVAGRQDED

SEQ ID NO: 3 - protein, 192 aa, Artificial
  VIF consensus polypeptide
MENRWQVMIVWQVDRMRIRTWNSLVKHHMYISKKAKGWFYRHHYESQHPKVSSEVHIPLGEARLVIRTYWGLQTGEKDWQLGHGVSIEWRQKRYSTQVDPDLADQLIHLQYFDCFSDSTIRRAILGQIVRRRCEYPSGHNKVGSLQYLALKALITPKKIRPPLPSVKKLTEDRWNKPQKIKGHRENHTMNGH

SEQ ID NO: 4 - protein, 96 aa, Artificial
  VPR consensus polypeptide
MEQAPEDQGPQREPYNEWALELLEELKQEAVRHFPRPWLHNLGQYIYETYGDTWSGVEALIRTLQQLMFIHFRIGCQHSRIGILRQRRARNGASRS

SEQ ID NO: 5 - protein, 102 aa, Artificial
  TAT consensus polypeptide
MDPVDPNLEPWNHPGSQPTTACSKCYCKKCCFHCQLCFLKKGLGISHGRKKRKQRRGAPQSRKDHQYPIPEQPLPQTRGGNPTDPKESKKEVASKTETDPCD

SEQ ID NO: 6 - protein, 123 aa, Artificial
  REV consensus polypeptide
MAGRSGSTDEELLRAVRIINILYQSNPYPSSEGTRQTRKNRRRRWRARQRQIRAISERILSTCLGRSAEPVPLQLPPLERLHLDCSEDCGTSGTQQSQGTETGVGRPQISGESSVILGPGTKN

SEQ ID NO: 7 - protein, 81 aa, Artificial
  VPU consensus polypeptide
MTPLEIIAIVAFIVALIIAIVVWTIAYIEYRKLLRQRRIDRLIKRTRERAEDSGNESEGDTEELSTMVDMGNYDLGVDNNL

SEQ ID NO: 8 - protein, 651 aa, Artificial
  ENV consensus polypeptide
MRVKETQMNWPNLWKWGTLILGLVIICSASDNLWVTVYYGVPVWRDADTTLFCASDAKAHETEVHNVWATHACVPTDPNPQEIHLENVTENFNMWKNNMVEQMQEDVISLWDQSLKPCVKLTPLCVTLNCTNANLINVNYRLINCNTSVIKQACPKVSFDPIPIHYCAPAGYAILKCNDKNFNGTGPCKNVSSVQCTHGIKPVVSTQLLLNGSLAEEEIIIRSENLTNNAKTIIVHLNESVEINCTRPNNNTRKTFRPGGGDIKDNWRSELYKYKVVKIEPLGVAPTRAKRRVVEREKRAVGIGAMIFGFLGAAGSTMGAASITLTVQARQLLSGIVQQQSNLLRAIEAQQHLLQLTVWGIKQLQARVLAVERYLKDQKFLGLWGCSGKIICTTAVPWNSSWSNKSLEEIWNNMTWMEWEREISNYTNQIYEILTESQNQQDRNEQELLELDKWASLWNWFDITNWLWYIKIFIMIVGGLIGLRIVFAVLSIVNRVRQGYSPLSFQTLLPAPRGPDRPEGIEEEGGEQDRDRSVRLVSGFLALAWDDLRSLCLFSYHRLRDLILIAARIVELLGHSSLRGLRRGWEALKYLWNLLQYWGQELKISAVSLLNATAIAVAEGTDRVIEVAQRAGRAILHIPRRIRQGLERALL

SEQ ID NO: 9 - protein, 206 aa, Artificial
  NEF consensus polypeptide
MGGKWSKSSLVGWPEVRERIRQTPPAAEGVGAVSQDLDKHGAITSSNTPANNADCVWLKAQEEEGVGFPVRPQVPLRPMTYKGAFDLSFFLKEKGGLEGLVYSKKRQEILDLWVYHTQGFFPDWHNYTPGPGIRYPLTFGWCFKLVPVDPREVEEINKGENNCLLHPMSQHGMEDEEREVLIWKFDSRLARRHIARELRPEFYKDC

SEQ ID NO: 10 - DNA, 90 bp, Artificial
  GAG segment 1
  CDS (1)..(90)
atgggcgccagggccagcrtcctcagmggcggcragctggacgcctgggaaaagattaggctcaggcctggcggaaagaaaaagtatarg

SEQ ID NO: 11 - protein, 30 aa, Artificial
  misc_feature (7)..(7): The 'Xaa' at location 7 stands for Val, or Ile.
  misc_feature (9)..(9): The 'Xaa' at location 9 stands for Arg, or Ser.
  misc_feature (12)..(12): The 'Xaa' at location 12 stands for Glu, or Lys.
  misc_feature (30)..(30): The 'Xaa' at location 30 stands for Arg, or Lys.
  GAG segment 1
MGARASXLXGGXLDAWEKIRLRPGGKKKYX

SEQ ID NO: 12 - DNA, 90 bp, Artificial
  GAG segment 2
  CDS (1)..(90)
tgggagaaaatcagactgagacccggaggcaaaaagaaatacaramtgaaacacmttgtgtgggcctccagggaactggaaaggtttgcc

SEQ ID NO: 13 - protein, 30 aa, Artificial
  misc_feature (15)..(15): The 'Xaa' at location 15 stands for Arg, or Lys.
  misc_feature (16)..(16): The 'Xaa' at location 16 stands for Met, or Leu.
  misc_feature (19)..(19): The 'Xaa' at location 19 stands for Ile, or Leu.
  GAG segment 2
WEKIRLRPGGKKKYXXKHXVWASRELERFA

SEQ ID NO: 14 - DNA, 90 bp, Artificial
  GAG segment 3
  CDS (1)..(90)
mtgaagcatmtcgtctgggctagcagagagctcgagagattcgctctgaatcccrgcctgctcgagacakccgaaggctgtmagcaaatt

SEQ ID NO: 15 - protein, 30 aa, Artificial
  misc_feature (1)..(1): The 'Xaa' at location 1 stands for Met, or Leu.
  misc_feature (4)..(4): The 'Xaa' at location 4 stands for Ile, or Leu.
  misc_feature (19)..(19): The 'Xaa' at location 19 stands for Gly, or Ser.
  misc_feature (24)..(24): The 'Xaa' at location 24 stands for Ala, or Ser.
  misc_feature (28)..(28): The 'Xaa' at location 28 stands for Lys, or Gln.
  GAG segment 3
XKHXVWASRELERFALNPXLLETXEGCXQI

SEQ ID NO: 16 - DNA, 90 bp, Artificial
  GAG segment 4
  CDS (1)..(90)
ctcaaccctrgcctcctggaaacckctgagggatgtmaacagatcctggracagctccagyccgccctcmagacaggcwccgaagagctc

SEQ ID NO: 17 - protein, 30 aa, Artificial
  misc_feature (4)..(4): The 'Xaa' at location 4 stands for Gly, or Ser.
  misc_feature (9)..(9): The 'Xaa' at location 9 stands for Ala, or Ser.
  misc_feature (13)..(13): The 'Xaa' at location 13 stands for Lys, or Gln.
  misc_feature (17)..(17): The 'Xaa' at location 17 stands for Gly, or Glu.
  misc_feature (21)..(21): The 'Xaa' at location 21 stands for Pro, or Ser.
  misc_feature (24)..(24): The 'Xaa' at location 24 stands for Lys, or Gln.
  misc_feature (27)..(27): The 'Xaa' at location 27 stands for Thr, or Ser.
  GAG segment 4
LNPXLLETXEGCXQILXQLQXALXTGXEEL

SEQ ID NO: 18 - DNA, 90 bp, Artificial
  GAG segment 5
  CDS (1)..(90)
ctcgrgcaactgcaayctgctctgmaaaccggawcagaggaactgargtccctgtwtaacacartcgctaccctctggtgtgtgcatcag

SEQ ID NO: 19 - protein, 30 aa, Artificial
  misc_feature (2)..(2): The 'Xaa' at location 2 stands for Gly, or Glu.
  misc_feature (6)..(6): The 'Xaa' at location 6 stands for Pro, or Ser.
  misc_feature (9)..(9): The 'Xaa' at location 9 stands for Lys, or Gln.
  misc_feature (12)..(12): The 'Xaa' at location 12 stands for Thr, or Ser.
  misc_feature (16)..(16): The 'Xaa' at location 16 stands for Arg, or Lys.
  misc_feature (19)..(19): The 'Xaa' at location 19 stands for Tyr, or Phe.
  misc_feature (22)..(22): The 'Xaa' at location 22 stands for Val, or Ile.
  GAG segment 5
LXQLQXALXTGXEELXSLXNTXATLWCVHQ

SEQ ID NO: 20 - DNA, 90 bp, Artificial
  GAG segment 6
  CDS (1)..(90)
araagcctctwcaataccrtcgccacactgtggtgcgtccaccaaaggattgasgtcarggacacaaaggaagccctcgacaaaatcgaa

SEQ ID NO: 21 - protein, 30 aa, Artificial
  misc_feature (1)..(1): The 'Xaa' at location 1 stands for Arg, or Lys.
  misc_feature (4)..(4): The 'Xaa' at location 4 stands for Tyr, or Phe.
  misc_feature (7)..(7): The 'Xaa' at location 7 stands for Val, or Ile.
  misc_feature (18)..(18): The 'Xaa' at location 18 stands for Glu, or Asp.
  misc_feature (20)..(20): The 'Xaa' at location 20 stands for Arg, or Lys.
  GAG segment 6
XSLXNTXATLWCVHQRIXVXDTKEALDKIE

SEQ ID NO: 22 - DNA, 90 bp, Artificial
  GAG segment 7
  CDS (1)..(90)
agaatcgawgtgaragataccaaagaggctctggataagattgaggaggwgcaaaasaaaagcmagcaaaagacacaacaggctgccgct

SEQ ID NO: 23 - protein, 30 aa, Artificial
  misc_feature (3)..(3): The 'Xaa' at location 3 stands for Glu, or Asp.
  misc_feature (5)..(5): The 'Xaa' at location 5 stands for Arg, or Lys.
  misc_feature (17)..(17): The 'Xaa' at location 17 stands for Glu, or Val.
  misc_feature (19)..(19): The 'Xaa' at location 19 stands for Lys, or Asn.
  misc_feature (22)..(22): The 'Xaa' at location 22 stands for Lys, or Gln.
  GAG segment 7
RIXVXDTKEALDKIEEXQXKSXQKTQQAAA

SEQ ID NO: 24 - DNA, 90 bp, Artificial
  GAG segment 8
  CDS (1)..(90)
gaagwacagaawaagtccmaacagaaaacccagcaagccgccgccgatacaggcarctccagcmaggtcagccaaaactatcccattgtg

SEQ ID NO: 25 - protein, 30 aa, Artificial
  misc_feature (2)..(2): The 'Xaa' at location 2 stands for Glu, or Val.
  misc_feature (4)..(4): The 'Xaa' at location 4 stands for Lys, or Asn.
  misc_feature (7)..(7): The 'Xaa' at location 7 stands for Lys, or Gln.
  misc_feature (19)..(19): The 'Xaa' at location 19 stands for Ser, or Asn.
  misc_feature (22)..(22): The 'Xaa' at location 22 stands for Lys, or Gln.
  GAG segment 8
EXQXKSXQKTQQAAADTGXSSXVSQNYPIV

SEQ ID NO: 26 - DNA, 90 bp, Artificial
  GAG segment 9
  CDS (1)..(90)
gacaccggaartagctccmaagtgtcccagaattaccctatcgtccagaatsyccaaggccaaatggtccaccaasccmtctcccccaga

SEQ ID NO: 27 - protein, 30 aa, Artificial
  misc_feature (4)..(4): The 'Xaa' at location 4 stands for Ser, or Asn.
  misc_feature (7)..(7): The 'Xaa' at location 7 stands for Lys, or Gln.
  misc_feature (18)..(18): The 'Xaa' at location 18 stands for Ala, Val, Pro, or Leu.
  misc_feature (26)..(26): The 'Xaa' at location 26 stands for Ala, or Pro.
  misc_feature (27)..(27): The 'Xaa' at location 27 stands for Ile, or Leu.
  GAG segment 9
DTGXSSXVSQNYPIVQNXQGQMVHQXXSPR

SEQ ID NO: 28 - DNA, 90 bp, Artificial
  GAG segment 10
  CDS (1)..(90)
caaaacsyccagggacagatggtgcatcagsctmttagccctaggaccctcaacgcttgggtcaaggtcrtcgaagagaaagsctttarc

SEQ ID NO: 29 - protein, 30 aa, Artificial
  misc_feature (3)..(3): The 'Xaa' at location 3 stands for Ala, Val, Pro, or Leu.
  misc_feature (11)..(11): The 'Xaa' at location 11 stands for Ala, or Pro.
  misc_feature (12)..(12): The 'Xaa' at location 12 stands for Ile, or Leu.
  misc_feature (24)..(24): The 'Xaa' at location 24 stands for Val, or Ile.
  misc_feature (28)..(28): The 'Xaa' at location 28 stands for Gly, or Ala.
  misc_feature (30)..(30): The 'Xaa' at location 30 stands for Ser, or Asn.
  GAG segment 10
QNXQGQMVHQXXSPRTLNAWVKVXEEKXFX

SEQ ID NO: 30 - DNA, 90 bp, Artificial
  GAG segment 11
  CDS (1)..(90)
acactgaatgcctgggtgaaagtgrttgaggaaaaggsattcartcccgaagtgattcccatgtttwccgctctgtccgagggagccaca

SEQ ID NO: 31 - protein, 30 aa, Artificial
  misc_feature (9)..(9): The 'Xaa' at location 9 stands for Val, or Ile.
  misc_feature (13)..(13): The 'Xaa' at location 13 stands for Gly, or Ala.
  misc_feature (15)..(15): The 'Xaa' at location 15 stands for Ser, or Asn.
  misc_feature (23)..(23): The 'Xaa' at location 23 stands for Thr, or Ser.
  GAG segment 11
TLNAWVKVXEEKXFXPEVIPMFXALSEGAT

SEQ ID NO: 32 - DNA, 90 bp, Artificial
  GAG segment 12
  CDS (1)..(90)
cctgaggtcatccctatgttcwcagccctcagcgaaggcgctaccccccaagacctgaataygatgctcaacaycgtcggcggacaccaa

SEQ ID NO: 33 - protein, 30 aa, Artificial
  misc_feature (8)..(8): The 'Xaa' at location 8 stands for Thr, or Ser.
  misc_feature (21)..(21): The 'Xaa' at location 21 stands for Thr, or Met.
  misc_feature (25)..(25): The 'Xaa' at location 25 stands for Thr, or Ile.
  GAG segment 12
PEVIPMFXALSEGATPQDLNXMLNXVGGHQ

SEQ ID NO: 34 - DNA, 90 bp, Artificial
  GAG segment 13
  CDS (1)..(90)
cctcaggatctcaacaygatgctgaataytgtgggaggccatcaggccgctatgcaaatgctgaaagasacaatcaatgaggaagccgct

SEQ ID NO: 35 - protein, 30 aa, Artificial
  misc_feature (6)..(6): The 'Xaa' at location 6 stands for Thr, or Met.
  misc_feature (10)..(10): The 'Xaa' at location 10 stands for Thr, or Ile.
  misc_feature (23)..(23): The 'Xaa' at location 23 stands for Glu, or Asp.
  GAG segment 13
PQDLNXMLNXVGGHQAAMQMLKXTINEEAA

SEQ ID NO: 36 - DNA, 90 bp, Artificial
  GAG segment 14
  CDS (1)..(90)
gctgccatgcagatgctcaaggawaccattaacgaagaggctgccgagtgggacagartccatcccgtccatgccggacccrttscccct

SEQ ID NO: 37 - protein, 30 aa, Artificial
  misc_feature (8)..(8): The 'Xaa' at location 8 stands for Glu, or Asp.
  misc_feature (20)..(20): The 'Xaa' at location 20 stands for Val, or Ile.
  misc_feature (28)..(28): The 'Xaa' at location 28 stands for Val, or Ile.
  misc_feature (29)..(29): The 'Xaa' at location 29 stands for Ala, or Pro.
  GAG segment 14
AAMQMLKXTINEEAAEWDRXHPVHAGPXXP

SEQ ID NO: 38 - DNA, 90 bp, Artificial
  GAG segment 15
  CDS (1)..(90)
gaatgggataggrttcaccctgtgcacgctggccctrtcsctcccggccaaatsagagagcctaggggaagcgatatcgctggcacaacc

SEQ ID NO: 39 - protein, 30 aa, Artificial
  misc_feature (5)..(5): The 'Xaa' at location 5 stands for Val, or Ile.
  misc_feature (13)..(13): The 'Xaa' at location 13 stands for Val, or Ile.
  misc_feature (14)..(14): The 'Xaa' at location 14 stands for Ala, or Pro.
  misc_feature (18)..(18): The 'Xaa' at location 18 stands for Met, or Ile.
  GAG segment 15
EWDRXHPVHAGPXXPGQXREPRGSDIAGTT

SEQ ID NO: 40 - DNA, 90 bp, Artificial
  GAG segment 16
  CDS (1)..(90)
ggacagatragggaacccagaggctccgacattgccggaaccacaagcacactgcaagagcaaatcgsatggatgacaarcaatccccct

SEQ ID NO: 41 - protein, 30 aa, Artificial
  misc_feature (3)..(3): The 'Xaa' at location 3 stands for Met, or Ile.
  misc_feature (23)..(23): The 'Xaa' at location 23 stands for Gly, or Ala.
  misc_feature (27)..(27): The 'Xaa' at location 27 stands for Ser, or Asn.
  GAG segment 16
GQXREPRGSDIAGTTSTLQEQIXWMTXNPP

SEQ ID NO: 42 - DNA, 90 bp, Artificial
  GAG segment 17
  CDS (1)..(90)
tccaccctccaggaacagattgsctggatgacaartaaccctcccrtccctgtcggagasatttacaaaaggtggattatcctcggcctg

SEQ ID NO: 43 - protein, 30 aa, Artificial
  misc_feature (8)..(8): The 'Xaa' at location 8 stands for Gly, or Ala.
  misc_feature (12)..(12): The 'Xaa' at location 12 stands for Ser, or Asn.
  misc_feature (16)..(16): The 'Xaa' at location 16 stands for Val, or Ile.
  misc_feature (20)..(20): The 'Xaa' at location 20 stands for Glu, or Asp.
  GAG segment 17
STLQEQIXWMTXNPPXPVGXIYKRWIILGL

SEQ ID NO: 44 - DNA, 90 bp, Artificial
  GAG segment 18
  CDS (1)..(90)
rttcccgtgggcgawatctataagagatggatcattctgggactcaacaaaatcgtgagaatgtatymacccgtcagcattctggatatc

SEQ ID NO: 45 - protein, 30 aa, Artificial
  misc_feature (1)..(1): The 'Xaa' at location 1 stands for Val, or Ile.
  misc_feature (5)..(5): The 'Xaa' at location 5 stands for Glu, or Asp.
  misc_feature (23)..(23): The 'Xaa' at location 23 stands for Gln, Pro, or Ser.
  GAG segment 18
XPVGXIYKRWIILGLNKIVRMYXPVSILDI

SEQ ID NO: 46 - DNA, 90 bp, Artificial
  GAG segment 19
  CDS (1)..(90)
aataagattgtcaggatgtacymacctctctccatcctcgacattargcaaggccctaaggaaccctttagggattacgtcgacagattc

SEQ ID NO: 47 - protein, 30 aa, Artificial
  misc_feature (8)..(8): The 'Xaa' at location 8 stands for Gln, Pro, or Ser.
  misc_feature (16)..(16): The 'Xaa' at location 16 stands for Arg, or Lys.
  GAG segment 19
NKIVRMYXPLSILDIXQGPKEPFRDYVDRF

SEQ ID NO: 48 - DNA, 90 bp, Artificial
  GAG segment 20
  CDS (1)..(90)
aracagggacccaaagagcctttcagagactatgtggataggttttwcaaaaccctcagggctgagcaagccwcacaggawgtgaaaaac

SEQ ID NO: 49 - protein, 30 aa, Artificial
  misc_feature (1)..(1): The 'Xaa' at location 1 stands for Arg, or Lys.
  misc_feature (16)..(16): The 'Xaa' at location 16 stands for Tyr, or Phe.
  misc_feature (25)..(25): The 'Xaa' at location 25 stands for Thr, or Ser.
  misc_feature (27)..(27): The 'Xaa' at location 27 stands for Glu, or Asp.
  GAG segment 20
XQGPKEPFRDYVDRFXKTLRAEQAXQXVKN

SEQ ID NO: 50 - DNA, 90 bp, Artificial
  GAG segment 21
  CDS (1)..(90)
twtaagacactgagagccgaacaggctwcccaagasgtcaagaattggatgaccgasacactgctcgtgcaaaacgctaaccctgactgt

SEQ ID NO: 51 - protein, 30 aa, Artificial
  misc_feature (1)..(1): The 'Xaa' at location 1 stands for Tyr, or Phe.
  misc_feature (10)..(10): The 'Xaa' at location 10 stands for Thr, or Ser.
  misc_feature (12)..(12): The 'Xaa' at location 12 stands for Glu, or Asp.
  misc_feature (19)..(19): The 'Xaa' at location 19 stands for Glu, or Asp.
  GAG segment 21
XKTLRAEQAXQXVKNWMTXTLLVQNANPDC

SEQ ID NO: 52 - DNA, 90 bp, Artificial
  GAG segment 22
  CDS (1)..(90)
tggatgacagawaccctcctggtccagaatgccaatcccgattgcaagwccatcctcarggctctgggamccggagccwcactggaagag

SEQ ID NO: 53 - protein, 30 aa, Artificial
  misc_feature (4)..(4): The 'Xaa' at location 4 stands for Glu, or Asp.
  misc_feature (17)..(17): The 'Xaa' at location 17 stands for Thr, or Ser.
  misc_feature (20)..(20): The 'Xaa' at location 20 stands for Arg, or Lys.
  misc_feature (24)..(24): The 'Xaa' at location 24 stands for Thr, or Pro.
  misc_feature (27)..(27): The 'Xaa' at location 27 stands for Thr, or Ser.
  GAG segment 22
WMTXTLLVQNANPDCKXILXALGXGAXLEE

SEQ ID NO: 54 - DNA, 90 bp, Artificial
  GAG segment 23
  CDS (1)..(90)
aaawcaattctgaragccctcggcmcaggcgctwccctcgaggaaatgatgacagcctgtcagggagtgggaggccctrgccataaggct

SEQ ID NO: 55 - protein, 30 aa, Artificial
  misc_feature (2)..(2): The 'Xaa' at location 2 stands for Thr, or Ser.
  misc_feature (5)..(5): The 'Xaa' at location 5 stands for Arg, or Lys.
  misc_feature (9)..(9): The 'Xaa' at location 9 stands for Thr, or Pro.
  misc_feature (12)..(12): The 'Xaa' at location 12 stands for Thr, or Ser.
  misc_feature (27)..(27): The 'Xaa' at location 27 stands for Gly, or Ser.
  GAG segment 23
KXILXALGXGAXLEEMMTACQGVGGPXHKA

SEQ ID NO: 56 - DNA, 90 bp, Artificial
  GAG segment 24
  CDS (1)..(90)
atgatgaccgcttgccaaggcgtcggcggacccrgtcacaaagccagggtcctggcagaggctatgtcccaggygamcmacgctaacatt

SEQ ID NO: 57 - protein, 30 aa, Artificial
  misc_feature (12)..(12): The 'Xaa' at location 12 stands for Gly, or Ser.
  misc_feature (25)..(25): The 'Xaa' at location 25 stands for Ala, or Val.
  misc_feature (26)..(26): The 'Xaa' at location 26 stands for Asn, or Thr.
  misc_feature (27)..(27): The 'Xaa' at location 27 stands for Asn, or His.
  GAG segment 24
MMTACQGVGGPXHKARVLAEAMSQXXXANI

SEQ ID NO: 58 - DNA, 90 bp, Artificial
  GAG segment 25
  CDS (1)..(90)
agagtgctcgccgaagccatgagccaagycamcmatgccaatatcatgatgcagagaggcaatttcaraggccmaaagagaatcrtcaaa

SEQ ID NO: 59 - protein, 30 aa, Artificial
  misc_feature (10)..(10): The 'Xaa' at location 10 stands for Ala, or Val.
  misc_feature (11)..(11): The 'Xaa' at location 11 stands for Asn, or Thr.
  misc_feature (12)..(12): The 'Xaa' at location 12 stands for Asn, or His.
  misc_feature (23)..(23): The 'Xaa' at location 23 stands for Arg, or Lys.
  misc_feature (25)..(25): The 'Xaa' at location 25 stands for Gln, or Pro.
  misc_feature (29)..(29): The 'Xaa' at location 29 stands for Val, or Ile.
  GAG segment 25
RVLAEAMSQXXXANIMMQRGNFXGXKRIXK

SEQ ID NO: 60 - DNA, 90 bp, Artificial
  GAG segment 26
  CDS (1)..(90)
atgatgcaaaggggaaactttargggacmgaaaaggattrtcaagtgctttaactgtggaaaggaaggccatmtcgctargaattgcaga

SEQ ID NO: 61 - protein, 30 aa, Artificial
  misc_feature (8)..(8): The 'Xaa' at location 8 stands for Arg, or Lys.
  misc_feature (10)..(10): The 'Xaa' at location 10 stands for Gln, or Pro.
  misc_feature (14)..(14): The 'Xaa' at location 14 stands for Val, or Ile.
  misc_feature (25)..(25): The 'Xaa' at location 25 stands for Ile, or Leu.
  misc_feature (27)..(27): The 'Xaa' at location 27 stands for Arg, or Lys.
  GAG segment 26
MMQRGNFXGXKRIXKCFNCGKEGHXAXNCR

SEQ ID NO: 62 - DNA, 90 bp, Artificial
  GAG segment 27
  CDS (1)..(90)
tgtttcaattgcggcaaagagggacacmttgccaraaactgtagggcccctagaaagaaaggctgttggaaatgcggaarggaaggccat

SEQ ID NO: 63 - protein, 30 aa, Artificial
  misc_feature (10)..(10): The 'Xaa' at location 10 stands for Ile, or Leu.
  misc_feature (12)..(12): The 'Xaa' at location 12 stands for Arg, or Lys.
  misc_feature (27)..(27): The 'Xaa' at location 27 stands for Arg, or Lys.
  GAG segment 27
CFNCGKEGHXAXNCRAPRKKGCWKCGXEGH

SEQ ID NO: 64 - DNA, 90 bp, Artificial
  GAG segment 28
  CDS (1)..(90)
gctcccaggaaaaagggatgctggaagtgtggcaragagggacaccagatgaaggattgcacagagagacaggctaactttctgggaaag

SEQ ID NO: 65 - protein, 30 aa, Artificial
  misc_feature (12)..(12): The 'Xaa' at location 12 stands for Arg, or Lys.
  GAG segment 28
APRKKGCWKCGXEGHQMKDCTERQANFLGK

SEQ ID NO: 66 - DNA, 90 bp, Artificial
  GAG segment 29
  CDS (1)..(90)
caaatgaaagactgtaccgaaaggcaagccaatttcctcggcaaaatctggccctccmrcaaaggcagacccggaaactttcyccaaagc

SEQ ID NO: 67 - protein, 30 aa, Artificial
  misc_feature (20)..(20): The 'Xaa' at location 20 stands for Ser, Asn, Arg, or His.
  misc_feature (28)..(28): The 'Xaa' at location 28 stands for Pro, or Leu.
  GAG segment 29
QMKDCTERQANFLGKIWPSXKGRPGNFXQS

SEQ ID NO: 68 - DNA, 90 bp, Artificial
  GAG segment 30
  CDS (1)..(90)
atttggcctagcmrcaagggaaggcctggcaatttccygcagtccargcctgagcctaccgctccccctgccgaaarctttrgattcggc

SEQ ID NO: 69 - protein, 30 aa, Artificial
  misc_feature (5)..(5): The 'Xaa' at location 5 stands for Ser, Asn, Arg, or His.
  misc_feature (13)..(13): The 'Xaa' at location 13 stands for Pro, or Leu.
  misc_feature (16)..(16): The 'Xaa' at location 16 stands for Arg, or Lys.
  misc_feature (26)..(26): The 'Xaa' at location 26 stands for Ser, or Asn.
  misc_feature (28)..(28): The 'Xaa' at location 28 stands for Gly, or Arg.
  GAG segment 30
IWPSXKGRPGNFXQSXPEPTAPPAEXFXFG

SEQ ID NO: 70 - DNA, 90 bp, Artificial
  GAG segment 31
  CDS (1)..(90)
aracccgaacccacagcccctcccgctgagartttcrggttcggagaggaaaccacaccctcccmaaagcaagagcmaaaggataaggag

SEQ ID NO: 71 - protein, 30 aa, Artificial
  misc_feature (1)..(1): The 'Xaa' at location 1 stands for Arg, or Lys.
  misc_feature (11)..(11): The 'Xaa' at location 11 stands for Ser, or Asn.
  misc_feature (13)..(13): The 'Xaa' at location 13 stands for Gly, or Arg.
  misc_feature (22)..(22): The 'Xaa' at location 22 stands for Gln, or Pro.
  misc_feature (26)..(26): The 'Xaa' at location 26 stands for Gln, or Pro.
  GAG segment 31
XPEPTAPPAEXFXFGEETTPSXKQEXKDKE

SEQ ID NO: 72 - DNA, 90 bp, Artificial
  GAG segment 32
  CDS (1)..(90)
gaagagacaacccctagccmgaaacaggaacmgaaagacaaagaacwctaccccccttyagccagcctcaagtccctgtttggcaatgac

SEQ ID NO: 73 - protein, 30 aa, Artificial
  misc_feature (7)..(7): The 'Xaa' at location 7 stands for Gln, or Pro.
  misc_feature (11)..(11): The 'Xaa' at location 11 stands for Gln, or Pro.
  misc_feature (16)..(16): The 'Xaa' at location 16 stands for His, or Leu.
  misc_feature (20)..(20): The 'Xaa' at location 20 stands for Ser, or Leu.
  GAG segment 32
EETTPSXKQEXKDKEXYPPXASLKSLFGND

SEQ ID NO: 74 - DNA, 57 bp, Artificial
  GAG segment 33
  CDS (1)..(57)
cwctatcctccctyagcttccctgaaaagcctcttcggaaacgatccctyatcccaa

SEQ ID NO: 75 - protein, 19 aa, Artificial
  misc_feature (1)..(1): The 'Xaa' at location 1 stands for His, or Leu.
  misc_feature (5)..(5): The 'Xaa' at location 5 stands for Ser, or Leu.
  misc_feature (17)..(17): The 'Xaa' at location 17 stands for Ser, or Leu.
  GAG segment 33
XYPPXASLKSLFGNDPXSQ

SEQ ID NO: 76 - DNA, 90 bp, Artificial
  POL segment 1
  CDS (1)..(90)
ttctttagggaaamcctggctttccmgcaaggcraagccagagagtttyccagcgaacagacargagccaatagcyccrcctccaggaaa

SEQ ID NO: 77 - protein, 30 aa, Artificial
  misc_feature (5)..(5): The 'Xaa' at location 5 stands for Asn, or Thr.
  misc_feature (9)..(9): The 'Xaa' at location 9 stands for Gln, or Pro.
  misc_feature (12)..(12): The 'Xaa' at location 12 stands for Glu, or Lys.
  misc_feature (17)..(17): The 'Xaa' at location 17 stands for Pro, or Ser.
  misc_feature (22)..(22): The 'Xaa' at location 22 stands for Gly, or Arg.
  misc_feature (26)..(26): The 'Xaa' at location 26 stands for Pro, or Ser.
  misc_feature (27)..(27): The 'Xaa' at location 27 stands for Ala, or Thr.
  POL segment 1
FFREXLAFXQGXAREFXSEQTXANSXXSRK

SEQ ID NO: 78 - DNA, 90 bp, Artificial
  POL segment 2
  CDS (1)..(90)
ttcycttccgagcaaacargggctaactccyctrcaagcagaaagctgggagacggaggcggagccgasagacagggaacaagctccagc

SEQ ID NO: 79 - protein, 30 aa, Artificial
  misc_feature (2)..(2): The 'Xaa' at location 2 stands for Pro, or Ser.
  misc_feature (7)..(7): The 'Xaa' at location 7 stands for Gly, or Arg.
  misc_feature (11)..(11): The 'Xaa' at location 11 stands for Pro, or Ser.
  misc_feature (12)..(12): The 'Xaa' at location 12 stands for Ala, or Thr.
  misc_feature (23)..(23): The 'Xaa' at location 23 stands for Glu, or Asp.
  POL segment 2
FXSEQTXANSXXSRKLGDGGGAXRQGTSSS

SEQ ID NO: 80 - DNA, 90 bp, Artificial
  POL segment 3
  CDS (1)..(90)
ctcggcgatggcggaggcgctgawaggcaaggcacctccagctccytcarctttccccaaatcacactgtggcaaaggcctctggtcacc

SEQ ID NO: 81 - protein, 30 aa, Artificial
  misc_feature (8)..(8): The 'Xaa' at location 8 stands for Glu, or Asp.
  misc_feature (16)..(16): The 'Xaa' at location 16 stands for Leu, or Phe.
  misc_feature (17)..(17): The 'Xaa' at location 17 stands for Ser, or Asn.
  POL segment 3
LGDGGGAXRQGTSSSXXFPQITLWQRPLVT

SEQ ID NO: 82 - DNA, 90 bp, Artificial
  POL segment 4
  CDS (1)..(90)
yttartttccctcagattaccctctggcagagacccctcgtgacartcaaaatcggcggacagctcawagaggctctgctcgacacaggc

SEQ ID NO: 83 - protein, 30 aa, Artificial
  misc_feature (1)..(1): The 'Xaa' at location 1 stands for Leu, or Phe.
  misc_feature (2)..(2): The 'Xaa' at location 2 stands for Ser, or Asn.
  misc_feature (16)..(16): The 'Xaa' at location 16 stands for Val, or Ile.
  misc_feature (23)..(23): The 'Xaa' at location 23 stands for Lys, or Ile.
  POL segment 4
XXFPQITLWQRPLVTXKIGGQLXEALLDTG

SEQ ID NO: 84 - DNA, 90 bp, Artificial
  POL segment 5
  CDS (1)..(90)
rttaagattggaggccaactgawagaagccctcctggatacaggagccgatgacaccgtcctggaagawatsaatctgcctggcargtgg

SEQ ID NO: 85 - protein, 30 aa, Artificial
  misc_feature (1)..(1): The 'Xaa' at location 1 stands for Val, or Ile.
  misc_feature (8)..(8): The 'Xaa' at location 8 stands for Lys, or Ile.
  misc_feature (23)..(23): The 'Xaa' at location 23 stands for Glu, or Asp.
  misc_feature (24)..(24): The 'Xaa' at location 24 stands for Met, or Ile.
  misc_feature (29)..(29): The 'Xaa' at location 29 stands for Arg, or Lys.
  POL segment 5
XKIGGQLXEALLDTGADDTVLEXXNLPGXW

SEQ ID NO: 86 - DNA, 90 bp, Artificial
  POL segment 6
  CDS (1)..(90)
gctgacgatacagtgctcgaggasatsaacctccccggaaratggaagcctaagatgattggcggaatcggcggattcattaaggtgaga

SEQ ID NO: 87 - protein, 30 aa, Artificial
  misc_feature (8)..(8): The 'Xaa' at location 8 stands for Glu, or Asp.
  misc_feature (9)..(9): The 'Xaa' at location 9 stands for Met, or Ile.
  misc_feature (14)..(14): The 'Xaa' at location 14 stands for Arg, or Lys.
  POL segment 6
ADDTVLEXXNLPGXWKPKMIGGIGGFIKVR

SEQ ID NO: 88 - DNA, 90 bp, Artificial
  POL segment 7
  CDS (1)..(90)
aaacccaaaatgatcggaggcattggaggctttatcaaagtcaggcagtatgaccaaatcmttatcgaaatctgtggamasaaggctatc

SEQ ID NO: 89 - protein, 30 aa, Artificial
  misc_feature (21)..(21): The 'Xaa' at location 21 stands for Ile, or Leu.
  misc_feature (27)..(27): The 'Xaa' at location 27 stands for Lys, Asn, Gln, or His.
  POL segment 7
KPKMIGGIGGFIKVRQYDQIXIEICGXKAI

SEQ ID NO: 90 - DNA, 90 bp, Artificial
  POL segment 8
  CDS (1)..(90)
caatacgatcagattmttattgagatttgcggcmasaaagccattggcacagtgctcgtgggacctacccctgtgaatatcattggcaga

SEQ ID NO: 91 - protein, 30 aa, Artificial
  misc_feature (6)..(6): The 'Xaa' at location 6 stands for Ile, or Leu.
  misc_feature (12)..(12): The 'Xaa' at location 12 stands for Lys, Asn, Gln, or His.
  POL segment 8
QYDQIXIEICGXKAIGTVLVGPTPVNIIGR

SEQ ID NO: 92 - DNA, 90 bp, Artificial
  POL segment 9
  CDS (1)..(90)
ggaaccgtcctggtcggccccacacccgtcaacattatcggaaggaacmtgctgacacagmttggcygcaccctcaactttcccattagc

SEQ ID NO: 93 - protein, 30 aa, Artificial
  misc_feature (17)..(17): The 'Xaa' at location 17 stands for Met, or Leu.
  misc_feature (21)..(21): The 'Xaa' at location 21 stands for Ile, or Leu.
  misc_feature (23)..(23): The 'Xaa' at location 23 stands for Arg, or Cys.
  POL segment 9
GTVLVGPTPVNIIGRNXLTQXGXTLNFPIS

SEQ ID NO: 94 - DNA, 90 bp, Artificial
  POL segment 10
  CDS (1)..(90)
aatmtgctcacccaamtcggaygcacactgaatttccctatctcccccattgasacagtgcctgtgaaactgaaacccggaatggatggc

SEQ ID NO: 95 - protein, 30 aa, Artificial
  misc_feature (2)..(2): The 'Xaa' at location 2 stands for Met, or Leu.
  misc_feature (6)..(6): The 'Xaa' at location 6 stands for Ile, or Leu.
  misc_feature (8)..(8): The 'Xaa' at location 8 stands for Arg, or Cys.
  misc_feature (18)..(18): The 'Xaa' at location 18 stands for Glu, or Asp.
  POL segment 10
NXLTQXGXTLNFPISPIXTVPVKLKPGMDG

SEQ ID NO: 96 - DNA, 90 bp, Artificial
  POL segment 11
  CDS (1)..(90)
cctatcgawaccgtccccgtcaagctcaagcctggcatggacggacccaaagtgaaacagtggcccctcaccgaagagaaaatcaaagcc

SEQ ID NO: 97 - protein, 30 aa, Artificial
  misc_feature (3)..(3): The 'Xaa' at location 3 stands for Glu, or Asp.
  POL segment 11
PIXTVPVKLKPGMDGPKVKQWPLTEEKIKA

SEQ ID NO: 98 - DNA, 90 bp, Artificial
  POL segment 12
  CDS (1)..(90)
cctaaggtcaagcaatggcctctgacagaggaaaagattaaggctctgacagmgatttgcamagagatggagvaagagggaaagattagc

SEQ ID NO: 99 - protein, 30 aa, Artificial
  misc_feature (18)..(18): The 'Xaa' at location 18 stands for Glu, or Ala.
  misc_feature (21)..(21): The 'Xaa' at location 21 stands for Lys, or Thr.
  misc_feature (25)..(25): The 'Xaa' at location 25 stands for Lys, Glu, or Gln.
  POL segment 12
PKVKQWPLTEEKIKALTXICXEMEXEGKIS

SEQ ID NO: 100 - DNA, 90 bp, Artificial
  POL segment 13
  CDS (1)..(90)
ctcaccgmgatctgtamagaaatggaavaagaaggcaaaatctccargattggccctgagaatccctataacacacccrtctttgccatt

SEQ ID NO: 101 - protein, 30 aa, Artificial
  misc_feature (3)..(3): The 'Xaa' at location 3 stands for Glu, or Ala.
  misc_feature (6)..(6): The 'Xaa' at location 6 stands for Lys, or Thr.
  misc_feature (10)..(10): The 'Xaa' at location 10 stands for Lys, Glu, or Gln.
  misc_feature (16)..(16): The 'Xaa' at location 16 stands for Arg, or Lys.
  misc_feature (27)..(27): The 'Xaa' at location 27 stands for Val, or Ile.
  POL segment 13
LTXICXEMEXEGKISXIGPENPYNTPXFAI

SEQ ID NO: 102 - DNA, 90 bp, Artificial
  POL segment 14
  CDS (1)..(90)
argatcggacccgaaaacccttacaatacccctrtcttcgctatcaagaaaaaggactccaccaaatggagaaagctcgtggatttcaga

SEQ ID NO: 103 - protein, 30 aa, Artificial
  misc_feature (1)..(1): The 'Xaa' at location 1 stands for Arg, or Lys.
  misc_feature (12)..(12): The 'Xaa' at location 12 stands for Val, or Ile.
  POL segment 14
XIGPENPYNTPXFAIKKKDSTKWRKLVDFR

SEQ ID NO: 104 - DNA, 90 bp, Artificial
  POL segment 15
  CDS (1)..(90)
aaaaagaaagatagcacaaagtggaggaaactggtcgactttagggagctcaacaaaaggacacaggatttctgggaggtccagctcggc

SEQ ID NO: 105 - protein, 30 aa, Artificial
  POL segment 15
KKKDSTKWRKLVDFRELNKRTQDFWEVQLG

SEQ ID NO: 106 - DNA, 90 bp, Artificial
  POL segment 16
  CDS (1)..(90)
gaactgaataagagaacccaagacttttgggaagtgcaactgggaatccctcaccctgctggactgaaaaagaaaaagtccgtgacagtg

SEQ ID NO: 107 - protein, 30 aa, Artificial
  POL segment 16
ELNKRTQDFWEVQLGIPHPAGLKKKKSVTV

SEQ ID NO: 108 - DNA, 90 bp, Artificial
  POL segment 17
  CDS (1)..(90)
attccccatcccgccggcctcaagaaaaagaaaagcgtcaccgtcctggatgtgggagacgcttactttagcgtccccctcgacraarrc

SEQ ID NO: 109 - protein, 30 aa, Artificial
  misc_feature (29)..(29): The 'Xaa' at location 29 stands for Glu, or Lys.
  misc_feature (30)..(30): The 'Xaa' at location 30 stands for Gly, Asp, Ser, or Asn.
  POL segment 17
IPHPAGLKKKKSVTVLDVGDAYFSVPLDXX

SEQ ID NO: 110 - DNA, 90 bp, Artificial
  POL segment 18
  CDS (1)..(90)
ctcgacgtcggcgatgcctatttctccgtgcctctggatraarrcttcagaaagtataccgctttcacaatccctagcayaaacaatgag

SEQ ID NO: 111 - protein, 30 aa, Artificial
  misc_feature (14)..(14): The 'Xaa' at location 14 stands for Glu, or Lys.
  misc_feature (15)..(15): The 'Xaa' at location 15 stands for Gly, Asp, Ser, or Asn.
  misc_feature (27)..(27): The 'Xaa' at location 27 stands for Thr, or Ile.
  POL segment 18
LDVGDAYFSVPLDXXFRKYTAFTIPSXNNE

SEQ ID NO: 112 - DNA, 90 bp, Artificial
  POL segment 19
  CDS (1)..(90)
tttaggaaatacacagcctttaccattccctccaycaataacgaaacccctggcattaggtatcagtataacgtcctgcctcagggatgg

SEQ ID NO: 113 - protein, 30 aa, Artificial
  misc_feature (12)..(12): The 'Xaa' at location 12 stands for Thr, or Ile.
  POL segment 19
FRKYTAFTIPSXNNETPGIRYQYNVLPQGW

SEQ ID NO: 114 - DNA, 90 bp, Artificial
  POL segment 20
  CDS (1)..(90)
acacccggaatcagataccaatacaatgtgctcccccaaggctggaagggatcccccsccattttccaaagctccatgmccmaaatcctc

SEQ ID NO: 115 - protein, 30 aa, Artificial
  misc_feature (20)..(20): The 'Xaa' at location 20 stands for Ala, or Pro.
  misc_feature (27)..(27): The 'Xaa' at location 27 stands for Thr, or Pro.
  misc_feature (28)..(28): The 'Xaa' at location 28 stands for Lys, or Gln.
  POL segment 20
TPGIRYQYNVLPQGWKGSPXIFQSSMXXIL

SEQ ID NO: 116 - DNA, 90 bp, Artificial
  POL segment 21
  CDS (1)..(90)
aaaggcagccctsctatctttcagtccagcatgmcamagattctggagccttttaggawamaaaaccctgasatggtcatctatcagtat

SEQ ID NO: 117 - protein, 30 aa, Artificial
  misc_feature (5)..(5): The 'Xaa' at location 5 stands for Ala, or Pro.
  misc_feature (12)..(12): The 'Xaa' at location 12 stands for Thr, or Pro.
  misc_feature (13)..(13): The 'Xaa' at location 13 stands for Lys, or Gln.
  misc_feature (20)..(20): The 'Xaa' at location 20 stands for Lys, or Ile.
  misc_feature (21)..(21): The 'Xaa' at location 21 stands for Lys, or Gln.
  misc_feature (24)..(24): The 'Xaa' at location 24 stands for Glu, or Asp.
  POL segment 21
KGSPXIFQSSMXXILEPFRXXNPXMVIYQY

SEQ ID NO: 118 - DNA, 90 bp, Artificial
  POL segment 22
  CDS (1)..(90)
gaacccttcagaawamagaatcccgawatggtgatttaccaatacatggacgatctgtatgtgggaagcgatctggaaatcggacagcat

SEQ ID NO: 119 - protein, 30 aa, Artificial
  misc_feature (5)..(5): The 'Xaa' at location 5 stands for Lys, or Ile.
  misc_feature (6)..(6): The 'Xaa' at location 6 stands for Lys, or Gln.
  misc_feature (9)..(9): The 'Xaa' at location 9 stands for Glu, or Asp.
  POL segment 22
EPFRXXNPXMVIYQYMDDLYVGSDLEIGQH

SEQ ID NO: 120 - DNA, 90 bp, Artificial
  POL segment 23
  CDS (1)..(90)
atggatgacctctacgtcggctccgacctcgagattggccaacacaggrccaaaatcgaagagctcaggsmacacctcctgaratgggga

SEQ ID NO: 121 - protein, 30 aa, Artificial
  misc_feature (17)..(17): The 'Xaa' at location 17 stands for Ala, or Thr.
  misc_feature (24)..(24): The 'Xaa' at location 24 stands for Glu, Ala, Gln, or Pro.
  misc_feature (28)..(28): The 'Xaa' at location 28 stands for Arg, or Lys.
  POL segment 23
MDDLYVGSDLEIGQHRXKIEELRXHLLXWG

SEQ ID NO: 122 - DNA, 90 bp, Artificial
  POL segment 24
  CDS (1)..(90)
agarcaaagattgaggaactgagasmgcatctgctcaratggggcttcacaacccctgacaaaaagcatcagaaagagcctccctttctg

SEQ ID NO: 123 - protein, 30 aa, Artificial
  misc_feature (2)..(2): The 'Xaa' at location 2 stands for Ala, or Thr.
  misc_feature (9)..(9): The 'Xaa' at location 9 stands for Glu, Ala, Gln, or Pro.
  misc_feature (13)..(13): The 'Xaa' at location 13 stands for Arg, or Lys.
  POL segment 24
RXKIEELRXHLLXWGFTTPDKKHQKEPPFL

SEQ ID NO: 124 - DNA, 90 bp, Artificial
  POL segment 25
  CDS (1)..(90)
tttaccacacccgataagaaacaccaaaaggaaccccctttcctctggatgggatacgaactgcatcccgataggtggaccgtccagcct

SEQ ID NO: 125 - protein, 30 aa, Artificial
  POL segment 25
FTTPDKKHQKEPPFLWMGYELHPDRWTVQP

SEQ ID NO: 126 - DNA, 90 bp, Artificial
  POL segment 26
  CDS (1)..(90)
tggatgggctatgagctccaccctgacagatggacagtgcaacccatcswgctccccgaaaaggastcctggacagtgaatgacattcag

SEQ ID NO: 127 - protein, 30 aa, Artificial
  misc_feature (17)..(17): The 'Xaa' at location 17 stands for Glu, Val, Gln, or Leu.
  misc_feature (22)..(22): The 'Xaa' at location 22 stands for Glu, or Asp.
  POL segment 26
WMGYELHPDRWTVQPIXLPEKXSWTVNDIQ

SEQ ID NO: 128 - DNA, 90 bp, Artificial
  POL segment 27
  CDS (1)..(90)
attswgctgcctgagaaagawagctggaccgtcaacgatatccaaaagctcgtgggaaagctcaactgggcctcccagatttacsccgga

SEQ ID NO: 129 - protein, 30 aa, Artificial
  misc_feature (2)..(2): The 'Xaa' at location 2 stands for Glu, Val, Gln, or Leu.
  misc_feature (7)..(7): The 'Xaa' at location 7 stands for Glu, or Asp.
  misc_feature (29)..(29): The 'Xaa' at location 29 stands for Ala, or Pro.
  POL segment 27
IXLPEKXSWTVNDIQKLVGKLNWASQIYXG

SEQ ID NO: 130 - DNA, 90 bp, Artificial
  POL segment 28
  CDS (1)..(90)
aaactggtcggcaaactgaattgggctagccaaatctatsctggcatcaaagtgargcaactgtgtaagctcctgagaggcrccaaagcc

SEQ ID NO: 131 - protein, 30 aa, Artificial
  misc_feature (14)..(14): The 'Xaa' at location 14 stands for Ala, or Pro.
  misc_feature (19)..(19): The 'Xaa' at location 19 stands for Arg, or Lys.
  misc_feature (28)..(28): The 'Xaa' at location 28 stands for Ala, or Thr.
  POL segment 28
KLVGKLNWASQIYXGIKVXQLCKLLRGXKA

SEQ ID NO: 132 - DNA, 90 bp, Artificial
  POL segment 29
  CDS (1)..(90)
attaaggtcaracagctctgcaaactgctcaggggarcaaaggctctgacagasattgtgmcactgacagaggaagccgaactggaactg

SEQ ID NO: 133 - protein, 30 aa, Artificial
  misc_feature (4)..(4): The 'Xaa' at location 4 stands for Arg, or Lys.
  misc_feature (13)..(13): The 'Xaa' at location 13 stands for Ala, or Thr.
  misc_feature (18)..(18): The 'Xaa' at location 18 stands for Glu, or Asp.
  misc_feature (21)..(21): The 'Xaa' at location 21 stands for Thr, or Pro.
  POL segment 29
IKVXQLCKLLRGXKALTXIVXLTEEAELEL

SEQ ID NO: 134 - DNA, 90 bp, Artificial
  POL segment 30
  CDS (1)..(90)
ctcaccgawatcgtcmcactcaccgaagaggctgagctcgagctcgmggaaaacagagagattctgarggaacccgtccacggagtgtat

SEQ ID NO: 135 - protein, 30 aa, Artificial
  misc_feature (3)..(3): The 'Xaa' at location 3 stands for Glu, or Asp.
  misc_feature (6)..(6): The 'Xaa' at location 6 stands for Thr, or Pro.
  misc_feature (16)..(16): The 'Xaa' at location 16 stands for Glu, or Ala.
  misc_feature (23)..(23): The 'Xaa' at location 23 stands for Arg, or Lys.
  POL segment 30
LTXIVXLTEEAELELXENREILXEPVHGVY

SEQ ID NO: 136 - DNA, 90 bp, Artificial
  POL segment 31
  CDS (1)..(90)
gmggagaatagggaaatcctcaragagcctgtgcatggcgtctactacgatccctccaaggatctgrtcgctgaartccaaaagcaaggc

SEQ ID NO: 137 - protein, 30 aa, Artificial
  misc_feature (1)..(1): The 'Xaa' at location 1 stands for Glu, or Ala.
  misc_feature (8)..(8): The 'Xaa' at location 8 stands for Arg, or Lys.
  misc_feature (23)..(23): The 'Xaa' at location 23 stands for Val, or Ile.
  misc_feature (26)..(26): The 'Xaa' at location 26 stands for Val, or Ile.
  POL segment 31
XENREILXEPVHGVYYDPSKDLXAEXQKQG

SEQ ID NO: 138 - DNA, 90 bp, Artificial
  POL segment 32
  CDS (1)..(90)
tatgaccctagcaaagacctcrttgccgagrttcagaaacagggacaggrtcagtggacatwtcagatttwccaagagcctttcaaaaac

SEQ ID NO: 139 - protein, 30 aa, Artificial
  misc_feature (8)..(8): The 'Xaa' at location 8 stands for Val, or Ile.
  misc_feature (11)..(11): The 'Xaa' at location 11 stands for Val, or Ile.
  misc_feature (17)..(17): The 'Xaa' at location 17 stands for Gly, or Asp.
  misc_feature (21)..(21): The 'Xaa' at location 21 stands for Tyr, or Phe.
  misc_feature (24)..(24): The 'Xaa' at location 24 stands for Tyr, or Phe.
  POL segment 32
YDPSKDLXAEXQKQGQXQWTXQIXQEPFKN

SEQ ID NO: 140 - DNA, 90 bp, Artificial
  POL segment 33
  CDS (1)..(90)
caagrccaatggacctwccaaatctwtcaggaaccctttaagaatctgaaaaccggaaagtatkccagaawgagargcgctcacacaaac

SEQ ID NO: 141 - protein, 30 aa, Artificial
  misc_feature (2)..(2): The 'Xaa' at location 2 stands for Gly, or Asp.
  misc_feature (6)..(6): The 'Xaa' at location 6 stands for Tyr, or Phe.
  misc_feature (9)..(9): The 'Xaa' at location 9 stands for Tyr, or Phe.
  misc_feature (22)..(22): The 'Xaa' at location 22 stands for Ala, or Ser.
  misc_feature (24)..(24): The 'Xaa' at location 24 stands for Lys, or Met.
  misc_feature (26)..(26): The 'Xaa' at location 26 stands for Gly, or Ser.
  POL segment 33
QXQWTXQIXQEPFKNLKTGKYXRXRXAHTN

SEQ ID NO: 142 - DNA, 90 bp, Artificial
  POL segment 34
  CDS (1)..(90)
ctcaagaccggcaaatackctaggawgaggrgtgcccataccaatgacctcargcaactgacagmggytgtgcaaaagrttgccacagag

SEQ ID NO: 143 - protein, 30 aa, Artificial
  misc_feature (7)..(7): The 'Xaa' at location 7 stands for Ala, or Ser.
  misc_feature (9)..(9): The 'Xaa' at location 9 stands for Lys, or Met.
  misc_feature (11)..(11): The 'Xaa' at location 11 stands for Gly, or Ser.
  misc_feature (18)..(18): The 'Xaa' at location 18 stands for Arg, or Lys.
  misc_feature (22)..(22): The 'Xaa' at location 22 stands for Glu, or Ala.
  misc_feature (23)..(23): The 'Xaa' at location 23 stands for Ala, or Val.
  misc_feature (27)..(27): The 'Xaa' at location 27 stands for Val, or Ile.
  POL segment 34
LKTGKYXRXRXAHTNDLXQLTXXVQKXATE

SEQ ID NO: 144 - DNA, 90 bp, Artificial
  POL segment 35
  CDS (1)..(90)
gatctgaracagctcaccgmagycgtccagaaartcgctaccgaaagcattgtgatttggggaaagacacccaaattcaractgcctatc

SEQ ID NO: 145 - protein, 30 aa, Artificial
  misc_feature (3)..(3): The 'Xaa' at location 3 stands for Arg, or Lys.
  misc_feature (7)..(7): The 'Xaa' at location 7 stands for Glu, or Ala.
  misc_feature (8)..(8): The 'Xaa' at location 8 stands for Ala, or Val.
  misc_feature (12)..(12): The 'Xaa' at location 12 stands for Val, or Ile.
  misc_feature (27)..(27): The 'Xaa' at location 27 stands for Arg, or Lys.
  POL segment 35
DLXQLTXXVQKXATESIVIWGKTPKFXLPI

SEQ ID NO: 146 - DNA, 90 bp, Artificial
  POL segment 36
  CDS (1)..(90)
tccatcgtcatctggggcaaaacccctaagtttargctccccattcagaragagacatgggaarcctggtggayggastattggcaagcc

SEQ ID NO: 147 - protein, 30 aa, Artificial
  misc_feature (12)..(12): The 'Xaa' at location 12 stands for Arg, or Lys.
  misc_feature (17)..(17): The 'Xaa' at location 17 stands for Arg, or Lys.
  misc_feature (22)..(22): The 'Xaa' at location 22 stands for Ala, or Thr.
  misc_feature (25)..(25): The 'Xaa' at location 25 stands for Thr, or Met.
  misc_feature (26)..(26): The 'Xaa' at location 26 stands for Glu, or Asp.
  POL segment 36
SIVIWGKTPKFXLPIQXETWEXWWXXYWQA

SEQ ID NO: 148 - DNA, 90 bp, Artificial
  POL segment 37
  CDS (1)..(90)
caaarggaaacctgggagrcttggtggayggamtactggcaggctacctggatccctgagtgggagtttgtgaatacccctcccctcgtg

SEQ ID NO: 149 - protein, 30 aa, Artificial
  misc_feature (2)..(2): The 'Xaa' at location 2 stands for Arg, or Lys.
  misc_feature (7)..(7): The 'Xaa' at location 7 stands for Ala, or Thr.
  misc_feature (10)..(10): The 'Xaa' at location 10 stands for Thr, or Met.
  misc_feature (11)..(11): The 'Xaa' at location 11 stands for Glu, or Asp.
  POL segment 37
QXETWEXWWXXYWQATWIPEWEFVNTPPLV

SEQ ID NO: 150 - DNA, 90 bp, Artificial
  POL segment 38
  CDS (1)..(90)
acatggattcccgaatgggaattcgtcaacacaccccctctggtcaagctctggtatcagctcgagaaagascctatcgytggcgytgag

SEQ ID NO: 151 - protein, 30 aa, Artificial
  misc_feature (24)..(24): The 'Xaa' at location 24 stands for Glu, or Asp.
  misc_feature (27)..(27): The 'Xaa' at location 27 stands for Ala, or Val.
  misc_feature (29)..(29): The 'Xaa' at location 29 stands for Ala, or Val.
  POL segment 38
TWIPEWEFVNTPPLVKLWYQLEKXPIXGXE

SEQ ID NO: 152 - DNA, 90 bp, Artificial
  POL segment 39
  CDS (1)..(90)
aaactgtggtaccaactggaaaaggamcccattgycggagycgaaaccttttacgtcgacggagccgctarcagagagacaaagctcggc

SEQ ID NO: 153 - protein, 30 aa, Artificial
  misc_feature (9)..(9): The 'Xaa' at location 9 stands for Glu, or Asp.
  misc_feature (12)..(12): The 'Xaa' at location 12 stands for Ala, or Val.
  misc_feature (14)..(14): The 'Xaa' at location 14 stands for Ala, or Val.
  misc_feature (24)..(24): The 'Xaa' at location 24 stands for Ser, or Asn.
  POL segment 39
KLWYQLEKXPIXGXETFYVDGAAXRETKLG

SEQ ID NO: 154 - DNA, 90 bp, Artificial
  POL segment 40
  CDS (1)..(90)
acattctatgtggatggcgctgccartagggaaaccaaactgggaaaggctggctatgtgacagacagaggcagacagaaartcrttagc

SEQ ID NO: 155 - protein, 30 aa, Artificial
  misc_feature (9)..(9): The 'Xaa' at location 9 stands for Ser, or Asn.
  misc_feature (28)..(28): The 'Xaa' at location 28 stands for Val, or Ile.
  misc_feature (29)..(29): The 'Xaa' at location 29 stands for Val, or Ile.
  POL segment 40
TFYVDGAAXRETKLGKAGYVTDRGRQKXXS

SEQ ID NO: 156 - DNA, 90 bp, Artificial
  POL segment 41
  CDS (1)..(90)
aaagccggatacgtcaccgataggggaaggcaaaagrttrtctccctgacagasacaaccaatcagaaaaccgaactgcawgccattcam

SEQ ID NO: 157 - protein, 30 aa, Artificial
  misc_feature (13)..(13): The 'Xaa' at location 13 stands for Val, or Ile.
  misc_feature (14)..(14): The 'Xaa' at location 14 stands for Val, or Ile.
  misc_feature (18)..(18): The 'Xaa' at location 18 stands for Glu, or Asp.
  misc_feature (27)..(27): The 'Xaa' at location 27 stands for Gln, or His.
  misc_feature (30)..(30): The 'Xaa' at location 30 stands for Gln, or His.
  POL segment 41
KAGYVTDRGRQKXXSLTXTTNQKTELXAIX

SEQ ID NO: 158 - DNA, 90 bp, Artificial
  POL segment 42
  CDS (1)..(90)
ctcaccgamaccacaaaccaaaagacagagctccamgctatccawctggctctgcaagactccggctyagaggtcaacattgtgacagac

SEQ ID NO: 159 - protein, 30 aa, Artificial
  misc_feature (3)..(3): The 'Xaa' at location 3 stands for Glu, or Asp.
  misc_feature (12)..(12): The 'Xaa' at location 12 stands for Gln, or His.
  misc_feature (15)..(15): The 'Xaa' at location 15 stands for Gln, or His.
  misc_feature (23)..(23): The 'Xaa' at location 23 stands for Ser, or Leu.
  POL segment 42
LTXTTNQKTELXAIXLALQDSGXEVNIVTD

SEQ ID NO: 160 - DNA, 90 bp, Artificial
  POL segment 43
  CDS (1)..(90)
ctcgccctccaggatagcggatyggaagtgaatatcgtcaccgatagccaatacgctctgggaatcattcwggctcagcctgacaraagc

SEQ ID NO: 161 - protein, 30 aa, Artificial
  misc_feature (8)..(8): The 'Xaa' at location 8 stands for Ser, or Leu.
  misc_feature (24)..(24): The 'Xaa' at location 24 stands for Gln, or Leu.
  misc_feature (29)..(29): The 'Xaa' at location 29 stands for Arg, or Lys.
  POL segment 43
LALQDSGXEVNIVTDSQYALGIIXAQPDXS

SEQ ID NO: 162 - DNA, 90 bp, Artificial
  POL segment 44
  CDS (1)..(90)
tcccagtatgccctcggcattatccwagcccaacccgatargtccgagtccgagstcgtgartcagattatcgaavagctcatcaaaaag

SEQ ID NO: 163 - protein, 30 aa, Artificial
  misc_feature (9)..(9): The 'Xaa' at location 9 stands for Gln, or Leu.
  misc_feature (14)..(14): The 'Xaa' at location 14 stands for Arg, or Lys.
  misc_feature (19)..(19): The 'Xaa' at location 19 stands for Val, or Leu.
  misc_feature (21)..(21): The 'Xaa' at location 21 stands for Ser, or Asn.
  misc_feature (26)..(26): The 'Xaa' at location 26 stands for Lys, Glu, or Gln.
  POL segment 44
SQYALGIIXAQPDXSESEXVXQIIEXLIKK

SEQ ID NO: 164 - DNA, 90 bp, Artificial
  POL segment 45
  CDS (1)..(90)
gagtccgagstcgtgartcagattatcgaavagctcatcaaaaaggaaarggtctacctckcctgggtgcctgcccacaagggaatcgga

SEQ ID NO: 165 - protein, 30 aa, Artificial
  misc_feature (4)..(4): The 'Xaa' at location 4 stands for Val, or Leu.
  misc_feature (6)..(6): The 'Xaa' at location 6 stands for Ser, or Asn.
  misc_feature (11)..(11): The 'Xaa' at location 11 stands for Lys, Glu, or Gln.
  misc_feature (17)..(17): The 'Xaa' at location 17 stands for Arg, or Lys.
  misc_feature (21)..(21): The 'Xaa' at location 21 stands for Ala, or Ser.
  POL segment 45
ESEXVXQIIEXLIKKEXVYLXWVPAHKGIG

SEQ ID NO: 166 - DNA, 90 bp, Artificial
  POL segment 46
  CDS (1)..(90)
gagaragtgtatctgkcttgggtccccgctcataaaggcattggcggaaacgaacaggtcgacaaactggtcakckctggcattaggaaa

SEQ ID NO: 167 - protein, 30 aa, Artificial
  misc_feature (2)..(2): The 'Xaa' at location 2 stands for Arg, or Lys.
  misc_feature (6)..(6): The 'Xaa' at location 6 stands for Ala, or Ser.
  misc_feature (25)..(25): The 'Xaa' at location 25 stands for Ser, or Ile.
  misc_feature (26)..(26): The 'Xaa' at location 26 stands for Ala, or Ser.
  POL segment 46
EXVYLXWVPAHKGIGGNEQVDKLVXXGIRK

SEQ ID NO: 168 - DNA, 90 bp, Artificial
  POL segment 47
  CDS (1)..(90)
ggcaatgagcaagtggataagctcgtgaktkccggaatcagaaaggtgctcttcctcgacggaatcrataaggctcaggaagagcacgaa

SEQ ID NO: 169 - protein, 30 aa, Artificial
  misc_feature (10)..(10): The 'Xaa' at location 10 stands for Ser, or Ile.
  misc_feature (11)..(11): The 'Xaa' at location 11 stands for Ala, or Ser.
  misc_feature (23)..(23): The 'Xaa' at location 23 stands for Asp, or Asn.
  POL segment 47
GNEQVDKLVXXGIRKVLFLDGIXKAQEEHE

SEQ ID NO: 170 - DNA, 90 bp, Artificial
  POL segment 48
  CDS (1)..(90)
gtcctgtttctggatggcattracaaagcccaagaggaacatgagargtatcactccaactggaggacaatggctarcgamttcaatctg

SEQ ID NO: 171 - protein, 30 aa, Artificial
  misc_feature (8)..(8): The 'Xaa' at location 8 stands for Asp, or Asn.
  misc_feature (16)..(16): The 'Xaa' at location 16 stands for Arg, or Lys.
  misc_feature (26)..(26): The 'Xaa' at location 26 stands for Ser, or Asn.
  misc_feature (27)..(27): The 'Xaa' at location 27 stands for Glu, or Asp.
  POL segment 48
VLFLDGIXKAQEEHEXYHSNWRTMAXXFNL

SEQ ID NO: 172 - DNA, 90 bp, Artificial
  POL segment 49
  CDS (1)..(90)
arataccatagcaattggagaaccatggccartgastttaacctcccccctatcgtcsctaaggaaatcgtcgccwrttgcgataagtgt

SEQ ID NO: 173 - protein, 30 aa, Artificial
  misc_feature (1)..(1): The 'Xaa' at location 1 stands for Arg, or Lys.
  misc_feature (11)..(11): The 'Xaa' at location 11 stands for Ser, or Asn.
  misc_feature (12)..(12): The 'Xaa' at location 12 stands for Glu, or Asp.
  misc_feature (20)..(20): The 'Xaa' at location 20 stands for Ala, or Pro.
  misc_feature (26)..(26): The 'Xaa' at location 26 stands for Ser, Asn, Cys, or Tyr.
  POL segment 49
XYHSNWRTMAXXFNLPPIVXKEIVAXCDKC

SEQ ID NO: 174 - DNA, 90 bp, Artificial
  POL segment 50
  CDS (1)..(90)
cctcccattgtgsccaaagagattgtggctwrctgtgacaaatgccagctcaagggagaggctatkcacggacaggtcractgtagccct

SEQ ID NO: 175 - protein, 30 aa, Artificial
  misc_feature (5)..(5): The 'Xaa' at location 5 stands for Ala, or Pro.
  misc_feature (11)..(11): The 'Xaa' at location 11 stands for Ser, Asn, Cys, or Tyr.
  misc_feature (22)..(22): The 'Xaa' at location 22 stands for Met, or Ile.
  misc_feature (27)..(27): The 'Xaa' at location 27 stands for Asp, or Asn.
  POL segment 50
PPIVXKEIVAXCDKCQLKGEAXHGQVXCSP

SEQ ID NO: 176 - DNA, 90 bp, Artificial
  POL segment 51
  CDS (1)..(90)
caactgaaaggcgaagccatscatggccaagtgrattgctcccccggcatttggcaactggattgcacacacctcgagggaaagrttatc

SEQ ID NO: 177 - protein, 30 aa, Artificial
  misc_feature (7)..(7): The 'Xaa' at location 7 stands for Met, or Ile.
  misc_feature (12)..(12): The 'Xaa' at location 12 stands for Asp, or Asn.
  misc_feature (29)..(29): The 'Xaa' at location 29 stands for Val, or Ile.
  POL segment 51
QLKGEAXHGQVXCSPGIWQLDCTHLEGKXI

SEQ ID NO: 178 - DNA, 90 bp, Artificial
  POL segment 52
  CDS (1)..(90)
ggaatctggcagctcgactgtacccatctggaaggcaaartcattctggtcgccgtccacgtcgcctccggctacattgaggctgaggtc

SEQ ID NO: 179 - protein, 30 aa, Artificial
  misc_feature (14)..(14): The 'Xaa' at location 14 stands for Val, or Ile.
  POL segment 52
GIWQLDCTHLEGKXILVAVHVASGYIEAEV

SEQ ID NO: 180 - DNA, 90 bp, Artificial
  POL segment 53
  CDS (1)..(90)
ctcgtggctgtgcatgtggctagcggatatatcgaagccgaagtgatccctgccgaaaccggacaggaaaccgcttactttmtcctcaag

SEQ ID NO: 181 - protein, 30 aa, Artificial
  misc_feature (28)..(28): The 'Xaa' at location 28 stands for Ile, or Leu.
  POL segment 53
LVAVHVASGYIEAEVIPAETGQETAYFXLK

SEQ ID NO: 182 - DNA, 90 bp, Artificial
  POL segment 54
  CDS (1)..(90)
attcccgctgagacaggccaagagacagcctatttcmttctgaaactggctggcagatggcctgtgararycattcacacagacaatggc

SEQ ID NO: 183 - protein, 30 aa, Artificial
  misc_feature (13)..(13): The 'Xaa' at location 13 stands for Ile, or Leu.
  misc_feature (23)..(23): The 'Xaa' at location 23 stands for Arg, or Lys.
  misc_feature (24)..(24): The 'Xaa' at location 24 stands for Ala, Val, Thr, or Ile.
  POL segment 54
IPAETGQETAYFXLKLAGRWPVXXIHTDNG

SEQ ID NO: 184 - DNA, 90 bp, Artificial
  POL segment 55
  CDS (1)..(90)
ctcgccggaaggtggcccgtcargryaatccataccgataacggaagcaatttcacaagcrctrccgtcaaggctgcctgctggtgggct

SEQ ID NO: 185 - protein, 30 aa, Artificial
  misc_feature (8)..(8): The 'Xaa' at location 8 stands for Arg, or Lys.
  misc_feature (9)..(9): The 'Xaa' at location 9 stands for Ala, Val, Thr, or Ile.
  misc_feature (21)..(21): The 'Xaa' at location 21 stands for Ala, or Thr.
  misc_feature (22)..(22): The 'Xaa' at location 22 stands for Ala, or Thr.
  POL segment 55
LAGRWPVXXIHTDNGSNFTSXXVKAACWWA

SEQ ID NO: 186 - DNA, 90 bp, Artificial
  POL segment 56
  CDS (1)..(90)
tccaactttacctccrccrctgtgaaagccgcttgttggtgggccrrtatcmaacaggaattcggaatcccttacaatccccaaagccaa

SEQ ID NO: 187 - protein, 30 aa, Artificial
  misc_feature (6)..(6): The 'Xaa' at location 6 stands for Ala, or Thr.
  misc_feature (7)..(7): The 'Xaa' at location 7 stands for Ala, or Thr.
  misc_feature (16)..(16): The 'Xaa' at location 16 stands for Gly, Asp, Ser, or Asn.
  misc_feature (18)..(18): The 'Xaa' at location 18 stands for Lys, or Gln.
  POL segment 56
SNFTSXXVKAACWWAXIXQEFGIPYNPQSQ

SEQ ID NO: 188 - DNA, 90 bp, Artificial
  POL segment 57
  CDS (1)..(90)
rrcattmagcaagagtttggcattccctataaccctcagtcccagggcgtcgtggaaagcatgaacaaagagctcaagaaaatcattggc

SEQ ID NO: 189 - protein, 30 aa, Artificial
  misc_feature (1)..(1): The 'Xaa' at location 1 stands for Gly, Asp, Ser, or Asn.
  misc_feature (3)..(3): The 'Xaa' at location 3 stands for Lys, or Gln.
  POL segment 57
XIXQEFGIPYNPQSQGVVESMNKELKKIIG

SEQ ID NO: 190 - DNA, 90 bp, Artificial
  POL segment 58
  CDS (1)..(90)
ggagtggtcgagtccatgaataaggaactgaaaaagattatcggacaggtcagggamcaggctgagcatctgaaaaccgctgtgcaaatg

SEQ ID NO: 191 - protein, 30 aa, Artificial
  misc_feature (19)..(19): The 'Xaa' at location 19 stands for Glu, or Asp.
  POL segment 58
GVVESMNKELKKIIGQVRXQAEHLKTAVQM

SEQ ID NO: 192 - DNA, 90 bp, Artificial
  POL segment 59
  CDS (1)..(90)
caagtgagagascaagccgaacacctcaagacagccgtccagatggccgtcttcattcacaatttcaaaaggaraggcggaatcggaggc

SEQ ID NO: 193 - protein, 30 aa, Artificial
  misc_feature (4)..(4): The 'Xaa' at location 4 stands for Glu, or Asp.
  misc_feature (25)..(25): The 'Xaa' at location 25 stands for Arg, or Lys.
  POL segment 59
QVRXQAEHLKTAVQMAVFIHNFKRXGGIGG

SEQ ID NO: 194 - DNA, 90 bp, Artificial
  POL segment 60
  CDS (1)..(90)
gctgtgtttatccataactttaagagaargggaggcattggcggatactccgccggagagagaatcrttgacattatcgctascgatatc

SEQ ID NO: 195 - protein, 30 aa, Artificial
  misc_feature (10)..(10): The 'Xaa' at location 10 stands for Arg, or Lys.
  misc_feature (23)..(23): The 'Xaa' at location 23 stands for Val, or Ile.
  misc_feature (28)..(28): The 'Xaa' at location 28 stands for Ser, or Thr.
  POL segment 60
AVFIHNFKRXGGIGGYSAGERIXDIIAXDI

SEQ ID NO: 196 - DNA, 90 bp, Artificial
  POL segment 61
  CDS (1)..(90)
tatagcgctggcgaaaggattrtcgatatcattgccwccgacattcagtataaggaactgcaaaascaaatcmyaaagattcagaatttc

SEQ ID NO: 197 - protein, 30 aa, Artificial
  misc_feature (8)..(8): The 'Xaa' at location 8 stands for Val, or Ile.
  misc_feature (13)..(13): The 'Xaa' at location 13 stands for Thr, or Ser.
  misc_feature (22)..(22): The 'Xaa' at location 22 stands for Lys, or Asn.
  misc_feature (25)..(25): The 'Xaa' at location 25 stands for Thr, Ile, Pro, or Leu.
  POL segment 61
YSAGERIXDIIAXDIQYKELQXQIXKIQNF

SEQ ID NO: 198 - DNA, 90 bp, Artificial
  POL segment 62
  CDS (1)..(90)
caatacaaagagctccagaamcagattmycaaaatccaaaactttagggtctactatagggatagcagagaccctmtctggaagggaccc

SEQ ID NO: 199 - protein, 30 aa, Artificial
  misc_feature (7)..(7): The 'Xaa' at location 7 stands for Lys, or Asn.
  misc_feature (10)..(10): The 'Xaa' at location 10 stands for Thr, Ile, Pro, or Leu.
  misc_feature (26)..(26): The 'Xaa' at location 26 stands for Ile, or Leu.
  POL segment 62
QYKELQXQIXKIQNFRVYYRDSRDPXWKGP

SEQ ID NO: 200 - DNA, 90 bp, Artificial
  POL segment 63
  CDS (1)..(90)
agagtgtattacagagactccagggatcccmtttggaaaggccctgccaaactgctctggaaaggcgaaggcgctgtggtcatccaagac

SEQ ID NO: 201 - protein, 30 aa, Artificial
  misc_feature (11)..(11): The 'Xaa' at location 11 stands for Ile, or Leu.
  POL segment 63
RVYYRDSRDPXWKGPAKLLWKGEGAVVIQD

SEQ ID NO: 202 - DNA, 90 bp, Artificial
  POL segment 64
  CDS (1)..(90)
gctaagctcctgtggaagggagagggagccgtcgtgattcaggataactccgacattaaggtcgtgcctaggagaaaggctaagattatc

SEQ ID NO: 203 - protein, 30 aa, Artificial
  POL segment 64
AKLLWKGEGAVVIQDNSDIKVVPRRKAKII

SEQ ID NO: 204 - DNA, 90 bp, Artificial
  POL segment 65
  CDS (1)..(90)
aatagcgatatcaaagtggtccccagaaggaaagccaaaatcattagggattacggaaagcaaatggctggcgmtgactgtgtggctrgc

SEQ ID NO: 205 - protein, 30 aa, Artificial
  misc_feature (25)..(25): The 'Xaa' at location 25 stands for Asp, or Ala.
  misc_feature (30)..(30): The 'Xaa' at location 30 stands for Gly, or Ser.
  POL segment 65
NSDIKVVPRRKAKIIRDYGKQMAGXDCVAX

SEQ ID NO: 206 - DNA, 60 bp, Artificial
  POL segment 66
  CDS (1)..(60)
agggattacggaaagcaaatggctggcgmtgactgtgtggctrgcaggcaagacgaagac

SEQ ID NO: 207 - protein, 20 aa, Artificial
  misc_feature (10)..(10): The 'Xaa' at location 10 stands for Asp, or Ala.
  misc_feature (15)..(15): The 'Xaa' at location 15 stands for Gly, or Ser.
  POL segment 66
RDYGKQMAGXDCVAXRQDED

SEQ ID NO: 208 - DNA, 90 bp, Artificial
  VIF segment 1
  CDS (1)..(90)
atggaaaacagatggcaagtgmtgatcgtctggcaagtggataggatgargattaggacatggaawagcctcgtgaaacaccatatgyat

SEQ ID NO: 209 - protein, 30 aa, Artificial
  misc_feature (8)..(8): The 'Xaa' at location 8 stands for Met, or Leu.
  misc_feature (17)..(17): The 'Xaa' at location 17 stands for Arg, or Lys.
  misc_feature (22)..(22): The 'Xaa' at location 22 stands for Lys, or Asn.
  misc_feature (30)..(30): The 'Xaa' at location 30 stands for His, or Tyr.
  VIF segment 1
MENRWQVXIVWQVDRMXIRTWXSLVKHHMX

SEQ ID NO: 210 - DNA, 90 bp, Artificial
  VIF segment 2
  CDS (1)..(90)
atgaraatcagatactggaasaccctggtcaagcatcacatgyacatctccaagaaagccaawggctggttctataggcatcactwtgas

SEQ ID NO: 211 - protein, 30 aa, Artificial
  misc_feature (2)..(2): The 'Xaa' at location 2 stands for Arg, or Lys.
  misc_feature (7)..(7): The 'Xaa' at location 7 stands for Lys, or Asn.
  misc_feature (15)..(15): The 'Xaa' at location 15 stands for His, or Tyr.
  misc_feature (21)..(21): The 'Xaa' at location 21 stands for Lys, or Asn.
  misc_feature (29)..(29): The 'Xaa' at location 29 stands for Tyr, or Phe.
  misc_feature (30)..(30): The 'Xaa' at location 30 stands for Glu, or Asp.
  VIF segment 2
MXIRYWXTLVKHHMXISKKAXGWFYRHHXX

SEQ ID NO: 212 - DNA, 90 bp, Artificial
  VIF segment 3
  CDS (1)..(90)
attagcaaaaaggctaasggatggttttacagacaccattwcgawagccracaccctaaggtcagctccgaggtccacattcccctcggc

SEQ ID NO: 213 - protein, 30 aa, Artificial
  misc_feature (6)..(6): The 'Xaa' at location 6 stands for Lys, or Asn.
  misc_feature (14)..(14): The 'Xaa' at location 14 stands for Tyr, or Phe.
  misc_feature (15)..(15): The 'Xaa' at location 15 stands for Glu, or Asp.
  misc_feature (17)..(17): The 'Xaa' at location 17 stands for Arg, or Gln.
  VIF segment 3
ISKKAXGWFYRHHXXSXHPKVSSEVHIPLG

SEQ ID NO: 214 - DNA, 90 bp, Artificial
  VIF segment 4
  CDS (1)..(90)
tcccrgcatcccaaagtgtccagcgaagtgcatatccctctgggagasgctaggctcrtcattargacatactggggcctccasacaggc

SEQ ID NO: 215 - protein, 30 aa, Artificial
  misc_feature (2)..(2): The 'Xaa' at location 2 stands for Arg, or Gln.
  misc_feature (16)..(16): The 'Xaa' at location 16 stands for Glu, or Asp.
  misc_feature (20)..(20): The 'Xaa' at location 20 stands for Val, or Ile.
  misc_feature (22)..(22): The 'Xaa' at location 22 stands for Arg, or Lys.
  misc_feature (28)..(28): The 'Xaa' at location 28 stands for Gln, or His.
  VIF segment 4
SXHPKVSSEVHIPLGXARLXIXTYWGLXTG

SEQ ID NO: 216 - DNA, 90 bp, Artificial
  VIF segment 5
  CDS (1)..(90)
gawgccagactgrttatcaraacctattggggactgcawaccggagagaragactggcasctcggccawggcgtcagcattgagtggagg

SEQ ID NO: 217 - protein, 30 aa, Artificial
  misc_feature (1)..(1): The 'Xaa' at location 1 stands for Glu, or Asp.
  misc_feature (5)..(5): The 'Xaa' at location 5 stands for Val, or Ile.
  misc_feature (7)..(7): The 'Xaa' at location 7 stands for Arg, or Lys.
  misc_feature (13)..(13): The 'Xaa' at location 13 stands for Gln, or His.
  misc_feature (17)..(17): The 'Xaa' at location 17 stands for Arg, or Lys.
  misc_feature (20)..(20): The 'Xaa' at location 20 stands for Gln, or His.
  misc_feature (23)..(23): The 'Xaa' at location 23 stands for Gln, or His.
  VIF segment 5
XARLXIXTYWGLXTGEXDWXLGXGVSIEWR

SEQ ID NO: 218 - DNA, 90 bp, Artificial
  VIF segment 6
  CDS (1)..(90)
gaaarggattggcawctgggacasggagtgtccatcgaatggagamwgaaaagstatagcacacaggtcgaccctgrcctcgccgatcas

SEQ ID NO: 219 - protein, 30 aa, Artificial
  misc_feature (2)..(2): The 'Xaa' at location 2 stands for Arg, or Lys.
  misc_feature (5)..(5): The 'Xaa' at location 5 stands for Gln, or His.
  misc_feature (8)..(8): The 'Xaa' at location 8 stands for Gln, or His.
  misc_feature (16)..(16): The 'Xaa' at location 16 stands for Lys, Met, Gln, or Leu.
  misc_feature (18)..(18): The 'Xaa' at location 18 stands for Arg, or Ser.
  misc_feature (26)..(26): The 'Xaa' at location 26 stands for Gly, or Asp.
  misc_feature (30)..(30): The 'Xaa' at location 30 stands for Gln, or His.
  VIF segment 6
EXDWXLGXGVSIEWRXKXYSTQVDPXLADX

SEQ ID NO: 220 - DNA, 90 bp, Artificial
  VIF segment 7
  CDS (1)..(90)
mwgaagagmtactccacccaagtggatcccgrtctggctgaccawctgattcacctcyastatttcgattgctttkccgatagcrcaatc

SEQ ID NO: 221 - protein, 30 aa, Artificial
  misc_feature (1)..(1): The 'Xaa' at location 1 stands for Lys, Met, Gln, or Leu.
  misc_feature (3)..(3): The 'Xaa' at location 3 stands for Arg, or Ser.
  misc_feature (11)..(11): The 'Xaa' at location 11 stands for Gly, or Asp.
  misc_feature (15)..(15): The 'Xaa' at location 15 stands for Gln, or His.
  misc_feature (20)..(20): The 'Xaa' at location 20 stands for Gln, His, or Tyr.
  misc_feature (26)..(26): The 'Xaa' at location 26 stands for Ala, or Ser.
  misc_feature (29)..(29): The 'Xaa' at location 29 stands for Ala, or Thr.
  VIF segment 7
XKXYSTQVDPXLADXLIHLXYFDCFXDSXI

SEQ ID NO: 222 - DNA, 90 bp, Artificial
  VIF segment 8
  CDS (1)..(90)
ctcatccatctgyawtactttgactgtttckctgactccrccattaggagagccattctgggacasakagtgagmaggagatgcgaatac

SEQ ID NO: 223 - protein, 30 aa, Artificial
  misc_feature (5)..(5): The 'Xaa' at location 5 stands for Gln, His, or Tyr.
  misc_feature (11)..(11): The 'Xaa' at location 11 stands for Ala, or Ser.
  misc_feature (14)..(14): The 'Xaa' at location 14 stands for Ala, or Thr.
  misc_feature (22)..(22): The 'Xaa' at location 22 stands for Gln, or His.
  misc_feature (23)..(23): The 'Xaa' at location 23 stands for Arg, or Ile.
  misc_feature (25)..(25): The 'Xaa' at location 25 stands for Arg, or Ser.
  VIF segment 8
LIHLXYFDCFXDSXIRRAILGXXVXRRCEY

SEQ ID NO: 224 - DNA, 90 bp, Artificial
  VIF segment 9
  CDS (1)..(90)
agaagggctatcctcggccawakagtcagsagaaggtgtgagtatcmgkccggacacaataaggtcggctccctgcaatacctcgccctc

SEQ ID NO: 225 - protein, 30 aa, Artificial
  misc_feature (7)..(7): The 'Xaa' at location 7 stands for Gln, or His.
  misc_feature (8)..(8): The 'Xaa' at location 8 stands for Arg, or Ile.
  misc_feature (10)..(10): The 'Xaa' at location 10 stands for Arg, or Ser.
  misc_feature (16)..(16): The 'Xaa' at location 16 stands for Gln, or Pro.
  misc_feature (17)..(17): The 'Xaa' at location 17 stands for Ala, or Ser.
  VIF segment 9
RRAILGXXVXRRCEYXXGHNKVGSLQYLAL

SEQ ID NO: 226 - DNA, 90 bp, Artificial
  VIF segment 10
  CDS (1)..(90)
cmakctggccataacaaagtgggaagcctccagtatctggctctgamggctctgattamgcctaagaaaatcaraccccctctgcctagc

SEQ ID NO: 227 - protein, 30 aa, Artificial
  misc_feature (1)..(1): The 'Xaa' at location 1 stands for Gln, or Pro.
  misc_feature (2)..(2): The 'Xaa' at location 2 stands for Ala, or Ser.
  misc_feature (16)..(16): The 'Xaa' at location 16 stands for Lys, or Thr.
  misc_feature (20)..(20): The 'Xaa' at location 20 stands for Lys, or Thr.
  misc_feature (25)..(25): The 'Xaa' at location 25 stands for Arg, or Lys.
  VIF segment 10
XXGHNKVGSLQYLALXALIXPKKIXPPLPS

SEQ ID NO: 228 - DNA, 90 bp, Artificial
  VIF segment 11
  CDS (1)..(90)
amagccctcatcamacccaaaaagattargcctcccctcccctccgtgaaaaagctcaccgaagacaratggaatragcctcaaaagaya

SEQ ID NO: 229 - protein, 30 aa, Artificial
  misc_feature (1)..(1): The 'Xaa' at location 1 stands for Lys, or Thr.
  misc_feature (5)..(5): The 'Xaa' at location 5 stands for Lys, or Thr.
  misc_feature (10)..(10): The 'Xaa' at location 10 stands for Arg, or Lys.
  misc_feature (23)..(23): The 'Xaa' at location 23 stands for Arg, or Lys.
  misc_feature (26)..(26): The 'Xaa' at location 26 stands for Glu, or Lys.
  misc_feature (30)..(30): The 'Xaa' at location 30 stands for Thr, or Ile.
  VIF segment 11
XALIXPKKIXPPLPSVKKLTEDXWNXPQKX

SEQ ID NO: 230 - DNA, 81 bp, Artificial
  VIF segment 12
  CDS (1)..(81)
gtcaagaaactgacagaggatargtggaacraaccccagaaaaycaagggacrcagagraaatcacacaatgaatggccat

SEQ ID NO: 231 - protein, 27 aa, Artificial
  misc_feature (8)..(8): The 'Xaa' at location 8 stands for Arg, or Lys.
  misc_feature (11)..(11): The 'Xaa' at location 11 stands for Glu, or Lys.
  misc_feature (15)..(15): The 'Xaa' at location 15 stands for Thr, or Ile.
  misc_feature (18)..(18): The 'Xaa' at location 18 stands for Arg, or His.
  misc_feature (20)..(20): The 'Xaa' at location 20 stands for Gly, or Glu.
  VIF segment 12
VKKLTEDXWNXPQKXKGXRXNHTMNGH

SEQ ID NO: 232 - DNA, 90 bp, Artificial
  VPR segment 1
  CDS (1)..(90)
atggaacaggctcccgaagaccaargcyctcagagagagccttacaatgagtggrccctcgagctcctggaagagctcaagmamgaggct

SEQ ID NO: 233 - protein, 30 aa, Artificial
  misc_feature (9)..(9): The 'Xaa' at location 9 stands for Gly, or Ser.
  misc_feature (10)..(10): The 'Xaa' at location 10 stands for Pro, or Ser.
  misc_feature (19)..(19): The 'Xaa' at location 19 stands for Ala, or Thr.
  misc_feature (28)..(28): The 'Xaa' at location 28 stands for Lys, Asn, Gln, or His.
  VPR segment 1
MEQAPEDQXXQREPYNEWXLELLEELKXEA

SEQ ID NO: 234 - DNA, 90 bp, Artificial
  VPR segment 2
  CDS (1)..(90)
aacgaatggrcactggaactgctcgaggaactgaaamawgaagccgtgagacactttcccagaccctggctgcatrrcctcggccaayac

SEQ ID NO: 235 - protein, 30 aa, Artificial
  misc_feature (4)..(4): The 'Xaa' at location 4 stands for Ala, or Thr.
  misc_feature (13)..(13): The 'Xaa' at location 13 stands for Lys, Asn, Gln, or His.
  misc_feature (26)..(26): The 'Xaa' at location 26 stands for Gly, Asp, Ser, or Asn.
  misc_feature (30)..(30): The 'Xaa' at location 30 stands for His, or Tyr.
  VPR segment 2
NEWXLELLEELKXEAVRHFPRPWLHXLGQX

SEQ ID NO: 236 - DNA, 90 bp, Artificial
  VPR segment 3
  CDS (1)..(90)
gtcaggcatttccctaggccttggctccacrrcctgggacagyacatctatgagacatacggagacacatggkmgggagtggaagccctc

SEQ ID NO: 237 - protein, 30 aa, Artificial
  misc_feature (11)..(11): The 'Xaa' at location 11 stands for Gly, Asp, Ser, or Asn.
  misc_feature (15)..(15): The 'Xaa' at location 15 stands for His, or Tyr.
  misc_feature (25)..(25): The 'Xaa' at location 25 stands for Glu, Ala, or Ser.
  VPR segment 3
VRHFPRPWLHXLGQXIYETYGDTWXGVEAL

SEQ ID NO: 238 - DNA, 90 bp, Artificial
  VPR segment 4
  CDS (1)..(90)
atttacgaaacctatggcgatacctggkmaggcgtcgaggctctgatcagaaycctccagcaactgmtgtttrtccatttcagaatcgga

SEQ ID NO: 239 - protein, 30 aa, Artificial
  misc_feature (10)..(10): The 'Xaa' at location 10 stands for Glu, Ala, or Ser.
  misc_feature (18)..(18): The 'Xaa' at location 18 stands for Thr, or Ile.
  misc_feature (23)..(23): The 'Xaa' at location 23 stands for Met, or Leu.
  misc_feature (25)..(25): The 'Xaa' at location 25 stands for Val, or Ile.
  VPR segment 4
IYETYGDTWXGVEALIRXLQQLXFXHFRIG

SEQ ID NO: 240 - DNA, 90 bp, Artificial
  VPR segment 5
  CDS (1)..(90)
attaggaycctgcaacagctcmtgttcrttcactttaggattggctgccrgcactccaggattggcattmycagacagagaagggscaga

SEQ ID NO: 241 - protein, 30 aa, Artificial
  misc_feature (3)..(3): The 'Xaa' at location 3 stands for Thr, or Ile.
  misc_feature (8)..(8): The 'Xaa' at location 8 stands for Met, or Leu.
  misc_feature (10)..(10): The 'Xaa' at location 10 stands for Val, or Ile.
  misc_feature (17)..(17): The 'Xaa' at location 17 stands for Arg, or Gln.
  misc_feature (24)..(24): The 'Xaa' at location 24 stands for Thr, Ile, Pro, or Leu.
  misc_feature (29)..(29): The 'Xaa' at location 29 stands for Gly, or Ala.
  VPR segment 5
IRXLQQLXFXHFRIGCXHSRIGIXRQRRXR

SEQ ID NO: 242 - DNA, 63 bp, Artificial
  VPR segment 6
  CDS (1)..(63)
tgtcracatagcagaatcggaatcmycaggcaaaggagagstaggaacggakcctccaggtcc

SEQ ID NO: 243 - protein, 21 aa, Artificial
  misc_feature (2)..(2): The 'Xaa' at location 2 stands for Arg, or Gln.
  misc_feature (9)..(9): The 'Xaa' at location 9 stands for Thr, Ile, Pro, or Leu.
  misc_feature (14)..(14): The 'Xaa' at location 14 stands for Gly, or Ala.
  misc_feature (18)..(18): The 'Xaa' at location 18 stands for Ala, or Ser.
  VPR segment 6
CXHSRIGIXRQRRXRNGXSRS

SEQ ID NO: 244 - DNA, 90 bp, Artificial
  TAT segment 1
  CDS (1)..(90)
atggawcycgtcgaccctaasctcgagccttggaawcaccctggctcccagcctamgacagcctgtwmcaaatgctattgcaaaaagtgc

SEQ ID NO: 245 - protein, 30 aa, Artificial
  misc_feature (2)..(2): The 'Xaa' at location 2 stands for Glu, or Asp.
  misc_feature (3)..(3): The 'Xaa' at location 3 stands for Pro, or Leu.
  misc_feature (7)..(7): The 'Xaa' at location 7 stands for Lys, or Asn.
  misc_feature (12)..(12): The 'Xaa' at location 12 stands for Lys, or Asn.
  misc_feature (19)..(19): The 'Xaa' at location 19 stands for Lys, or Thr.
  misc_feature (23)..(23): The 'Xaa' at location 23 stands for Asn, Thr, Tyr, or Ser.
  TAT segment 1
MXXVDPXLEPWXHPGSQPXTACXKCYCKKC

SEQ ID NO: 246 - DNA, 90 bp, Artificial
  TAT segment 2
  CDS (1)..(90)
agccaacccamaaccgcttgcwmcaagtgttactgtaagaaatgttgctwccactgtcagstctgcttcctgamaaagggactgggaatc

SEQ ID NO: 247 - protein, 30 aa, Artificial
  misc_feature (4)..(4): The 'Xaa' at location 4 stands for Lys, or Thr.
  misc_feature (8)..(8): The 'Xaa' at location 8 stands for Asn, Thr, Tyr, or Ser.
  misc_feature (17)..(17): The 'Xaa' at location 17 stands for Tyr, or Phe.
  misc_feature (21)..(21): The 'Xaa' at location 21 stands for Val, or Leu.
  misc_feature (25)..(25): The 'Xaa' at location 25 stands for Lys, or Thr.
  TAT segment 2
SQPXTACXKCYCKKCCXHCQXCFLXKGLGI

SEQ ID NO: 248 - DNA, 90 bp, Artificial
  TAT segment 3
  CDS (1)..(90)
tgttwtcattgccaastgtgttttctcamgaaaggcctcggcattagcyacggaaggaaaaagagaaracagagaaggsgagctccccaa

SEQ ID NO: 249 - protein, 30 aa, Artificial
  misc_feature (2)..(2): The 'Xaa' at location 2 stands for Tyr, or Phe.
  misc_feature (6)..(6): The 'Xaa' at location 6 stands for Val, or Leu.
  misc_feature (10)..(10): The 'Xaa' at location 10 stands for Lys, or Thr.
  misc_feature (17)..(17): The 'Xaa' at location 17 stands for His, or Tyr.
  misc_feature (23)..(23): The 'Xaa' at location 23 stands for Arg, or Lys.
  misc_feature (27)..(27): The 'Xaa' at location 27 stands for Gly, or Arg.
  TAT segment 3
CXHCQXCFLXKGLGISXGRKKRXQRRXAPQ

SEQ ID NO: 250 - DNA, 90 bp, Artificial
  TAT segment 4
  CDS (1)..(90)
tccyatggcagaaagaaaaggargcaaaggagasgcgcccctcagagcagmraggatcaccaataccctatcyctgagcaacccctcycc

SEQ ID NO: 251 - protein, 30 aa, Artificial
  misc_feature (2)..(2): The 'Xaa' at location 2 stands for His, or Tyr.
  misc_feature (8)..(8): The 'Xaa' at location 8 stands for Arg, or Lys.
  misc_feature (12)..(12): The 'Xaa' at location 12 stands for Gly, or Arg.
  misc_feature (17)..(17): The 'Xaa' at location 17 stands for Arg, or Ser.
  misc_feature (18)..(18): The 'Xaa' at location 18 stands for Glu, or Lys.
  misc_feature (25)..(25): The 'Xaa' at location 25 stands for Pro, or Ser.
  misc_feature (30)..(30): The 'Xaa' at location 30 stands for Pro, or Ser.
  TAT segment 4
SXGRKKRXQRRXAPQSXXDHQYPIXEQPLX

SEQ ID NO: 252 - DNA, 90 bp, Artificial
  TAT segment 5
  CDS (1)..(90)
tccagscaggaccatcagtatcccattyccgaacagcctctgyctcagmcaaggggagrcaatcccacagrccctraggaaagcaaaaag

SEQ ID NO: 253 - protein, 30 aa, Artificial
  misc_feature (2)..(2): The 'Xaa' at location 2 stands for Arg, or Ser.
  misc_feature (10)..(10): The 'Xaa' at location 10 stands for Pro, or Ser.
  misc_feature (15)..(15): The 'Xaa' at location 15 stands for Pro, or Ser.
  misc_feature (17)..(17): The 'Xaa' at location 17 stands for Thr, or Pro.
  misc_feature (20)..(20): The 'Xaa' at location 20 stands for Gly, or Asp.
  misc_feature (24)..(24): The 'Xaa' at location 24 stands for Gly, or Asp.
  misc_feature (26)..(26): The 'Xaa' at location 26 stands for Glu, or Lys.
  TAT segment 5
SXQDHQYPIXEQPLXQXRGXNPTXPXESKK

SEQ ID NO: 254 - DNA, 81 bp, Artificial
  TAT segment 6
  CDS (1)..(81)
caamccagaggcgrtaaccctaccgrtcccraagagtccaagaaaraggtcgmgtccaagrcagagacagacccttktgac

SEQ ID NO: 255 - protein, 27 aa, Artificial
  misc_feature (2)..(2): The 'Xaa' at location 2 stands for Thr, or Pro.
  misc_feature (5)..(5): The 'Xaa' at location 5 stands for Gly, or Asp.
  misc_feature (9)..(9): The 'Xaa' at location 9 stands for Gly, or Asp.
  misc_feature (11)..(11): The 'Xaa' at location 11 stands for Glu, or Lys.
  misc_feature (16)..(16): The 'Xaa' at location 16 stands for Glu, or Lys.
  misc_feature (18)..(18): The 'Xaa' at location 18 stands for Glu, or Ala.
  misc_feature (21)..(21): The 'Xaa' at location 21 stands for Ala, or Thr.
  misc_feature (26)..(26): The 'Xaa' at location 26 stands for Cys, or Phe.
  TAT segment 6
QXRGXNPTXPXESKKXVXSKXETDPXD

SEQ ID NO: 256 - DNA, 90 bp, Artificial
  REV segment 1
  CDS (1)..(90)
atggctggcagaagcggarrcacagacgaagagctcctgarggctrtcagaatcattaasattctgtatcagtccaacccttaccctwcc

SEQ ID NO: 257 - protein, 30 aa, Artificial
  misc_feature (7)..(7): The 'Xaa' at location 7 stands for Gly, Asp, Ser, or Asn.
  misc_feature (14)..(14): The 'Xaa' at location 14 stands for Arg, or Lys.
  misc_feature (16)..(16): The 'Xaa' at location 16 stands for Val, or Ile.
  misc_feature (20)..(20): The 'Xaa' at location 20 stands for Lys, or Asn.
  misc_feature (30)..(30): The 'Xaa' at location 30 stands for Thr, or Ser.
  REV segment 1
MAGRSGXTDEELLXAXRIIXILYQSNPYPX

SEQ ID NO: 258 - DNA, 90 bp, Artificial
  REV segment 2
  CDS (1)..(90)
rttaggattatcaawatcctctaccaaagcaatccctatcccwcaagcgaaggcwccaggcaarccagaargaataggagaaggagatgg

SEQ ID NO: 259 - protein, 30 aa, Artificial
  misc_feature (1)..(1): The 'Xaa' at location 1 stands for Val, or Ile.
  misc_feature (5)..(5): The 'Xaa' at location 5 stands for Lys, or Asn.
  misc_feature (15)..(15): The 'Xaa' at location 15 stands for Thr, or Ser.
  misc_feature (19)..(19): The 'Xaa' at location 19 stands for Thr, or Ser.
  misc_feature (22)..(22): The 'Xaa' at location 22 stands for Ala, or Thr.
  misc_feature (24)..(24): The 'Xaa' at location 24 stands for Arg, or Lys.
  REV segment 2
XRIIXILYQSNPYPXSEGXRQXRXNRRRRW

SEQ ID NO: 260 - DNA, 90 bp, Artificial
  REV segment 3
  CDS (1)..(90)
tccgagggawcaagacagrctaggaraaacagaaggagaaggtggagggmgaggcaaaggcaaatccrckccatctccgagwggattctg

SEQ ID NO: 261 - protein, 30 aa, Artificial
  misc_feature (4)..(4): The 'Xaa' at location 4 stands for Thr, or Ser.
  misc_feature (7)..(7): The 'Xaa' at location 7 stands for Ala, or Thr.
  misc_feature (9)..(9): The 'Xaa' at location 9 stands for Arg, or Lys.
  misc_feature (17)..(17): The 'Xaa' at location 17 stands for Glu, or Ala.
  misc_feature (23)..(23): The 'Xaa' at location 23 stands for Arg, or His.
  misc_feature (24)..(24): The 'Xaa' at location 24 stands for Ala, or Ser.
  misc_feature (28)..(28): The 'Xaa' at location 28 stands for Arg, or Trp.
  REV segment 3
SEGXRQXRXNRRRRWRXRQRQIXXISEXIL

SEQ ID NO: 262 - DNA, 90 bp, Artificial
  REV segment 4
  CDS (1)..(90)
agagmaagacagagacagattcrtkctattagcgaawggatcctcagcamctkcctcggcagayccgctgagcctgtgcctctgcaactg

SEQ ID NO: 263 - protein, 30 aa, Artificial
  misc_feature (2)..(2): The 'Xaa' at location 2 stands for Glu, or Ala.
  misc_feature (8)..(8): The 'Xaa' at location 8 stands for Arg, or His.
  misc_feature (9)..(9): The 'Xaa' at location 9 stands for Ala, or Ser.
  misc_feature (13)..(13): The 'Xaa' at location 13 stands for Arg, or Trp.
  misc_feature (17)..(17): The 'Xaa' at location 17 stands for Asn, or Thr.
  misc_feature (18)..(18): The 'Xaa' at location 18 stands for Cys, or Phe.
  misc_feature (22)..(22): The 'Xaa' at location 22 stands for Pro, or Ser.
  REV segment 4
RXRQRQIXXISEXILSXXLGRXAEPVPLQL

SEQ ID NO: 264 - DNA, 90 bp, Artificial
  REV segment 5
  CDS (1)..(90)
tccamctktctgggaaggyctgccgaacccgtccccctccagctcccccctctggaaaggctcmacctcgactgtagcgaagacwgtgrc

SEQ ID NO: 265 - protein, 30 aa, Artificial
  misc_feature (2)..(2): The 'Xaa' at location 2 stands for Asn, or Thr.
  misc_feature (3)..(3): The 'Xaa' at location 3 stands for Cys, or Phe.
  misc_feature (7)..(7): The 'Xaa' at location 7 stands for Pro, or Ser.
  misc_feature (22)..(22): The 'Xaa' at location 22 stands for Asn, or His.
  misc_feature (29)..(29): The 'Xaa' at location 29 stands for Ser, or Cys.
  misc_feature (30)..(30): The 'Xaa' at location 30 stands for Gly, or Asp.
  REV segment 5
SXXLGRXAEPVPLQLPPLERLXLDCSEDXX

SEQ ID NO: 266 - DNA, 90 bp, Artificial
  REV segment 6
  CDS (1)..(90)
cctcccctcgagagactgmacctggattgctccgaggatwgcgrtacctccggcacacagcaaagccaaggcacagagacaggagtggga

SEQ ID NO: 267 - protein, 30 aa, Artificial
  misc_feature (7)..(7): The 'Xaa' at location 7 stands for Asn, or His.
  misc_feature (14)..(14): The 'Xaa' at location 14 stands for Ser, or Cys.
  misc_feature (15)..(15): The 'Xaa' at location 15 stands for Gly, or Asp.
  REV segment 6
PPLERLXLDCSEDXXTSGTQQSQGTETGVG

SEQ ID NO: 268 - DNA, 90 bp, Artificial
  REV segment 7
  CDS (1)..(90)
acaagcggaacccaacagtcccagggaaccgaaaccggcgtcggcmrccctcagatttygggagagtccagcgytrtcctcggcyccgga

SEQ ID NO: 269 - protein, 30 aa, Artificial
  misc_feature (16)..(16): The 'Xaa' at location 16 stands for Ser, Asn, Arg, or His.
  misc_feature (20)..(20): The 'Xaa' at location 20 stands for Ser, or Leu.
  misc_feature (25)..(25): The 'Xaa' at location 25 stands for Ala, or Val.
  misc_feature (26)..(26): The 'Xaa' at location 26 stands for Val, or Ile.
  misc_feature (29)..(29): The 'Xaa' at location 29 stands for Pro, or Ser.
  REV segment 7
TSGTQQSQGTETGVGXPQIXGESSXXLGXG

SEQ ID NO: 270 - DNA, 54 bp, Artificial
  REV segment 8
  CDS (1)..(54)
mrcccccaaatctyaggcgaaagctccgycrttctgggayctggcaccaaaaac

SEQ ID NO: 271 - protein, 18 aa, Artificial
  misc_feature (1)..(1): The 'Xaa' at location 1 stands for Ser, Asn, Arg, or His.
  misc_feature (5)..(5): The 'Xaa' at location 5 stands for Ser, or Leu.
  misc_feature (10)..(10): The 'Xaa' at location 10 stands for Ala, or Val.
  misc_feature (11)..(11): The 'Xaa' at location 11 stands for Val, or Ile.
  misc_feature (14)..(14): The 'Xaa' at location 14 stands for Pro, or Ser.
  REV segment 8
XPQIXGESSXXLGXGTKN

SEQ ID NO: 272 - DNA, 90 bp, Artificial
  VPU segment 1
  CDS (1)..(90)
atgacayccctcsagaraatcgctatcgtcgccyttatcgtcgccctcatcmtagccattgtggtctggacaatcgyctwcattgagtat

SEQ ID NO: 273 - protein, 30 aa, Artificial
  misc_feature (3)..(3): The 'Xaa' at location 3 stands for Pro, or Ser.
  misc_feature (5)..(5): The 'Xaa' at location 5 stands for Glu, or Gln.
  misc_feature (6)..(6): The 'Xaa' at location 6 stands for Arg, or Lys.
  misc_feature (12)..(12): The 'Xaa' at location 12 stands for Leu, or Phe.
  misc_feature (18)..(18): The 'Xaa' at location 18 stands for Ile, or Leu.
  misc_feature (26)..(26): The 'Xaa' at location 26 stands for Ala, or Val.
  misc_feature (27)..(27): The 'Xaa' at location 27 stands for Tyr, or Phe.
  VPU segment 1
MTXLXXIAIVAXIVALIXAIVVWTIXXIEY

SEQ ID NO: 274 - DNA, 90 bp, Artificial
  VPU segment 2
  CDS (1)..(90)
ctgattmtcgctatcgtcgtgtggaccattgygtwtatcgaatacargaaactgctcargcaaaggaraatcgataggctcatcraaagg

SEQ ID NO: 275 - protein, 30 aa, Artificial
  misc_feature (3)..(3): The 'Xaa' at location 3 stands for Ile, or Leu.
  misc_feature (11)..(11): The 'Xaa' at location 11 stands for Ala, or Val.
  misc_feature (12)..(12): The 'Xaa' at location 12 stands for Tyr, or Phe.
  misc_feature (16)..(16): The 'Xaa' at location 16 stands for Arg, or Lys.
  misc_feature (20)..(20): The 'Xaa' at location 20 stands for Arg, or Lys.
  misc_feature (23)..(23): The 'Xaa' at location 23 stands for Arg, or Lys.
  misc_feature (29)..(29): The 'Xaa' at location 29 stands for Glu, or Lys.
  VPU segment 2
LIXAIVVWTIXXIEYXKLLXQRXIDRLIXR

SEQ ID NO: 276 - DNA, 90 bp, Artificial
  VPU segment 3
  CDS (1)..(90)
araaagctcctgaracagagaargattgacagactgattragagaaycagagagagagccgaagactccggcaatgagtccgagggagac

SEQ ID NO: 277 - protein, 30 aa, Artificial
  misc_feature (1)..(1): The 'Xaa' at location 1 stands for Arg, or Lys.
  misc_feature (5)..(5): The 'Xaa' at location 5 stands for Arg, or Lys.
  misc_feature (8)..(8): The 'Xaa' at location 8 stands for Arg, or Lys.
  misc_feature (14)..(14): The 'Xaa' at location 14 stands for Glu, or Lys.
  misc_feature (16)..(16): The 'Xaa' at location 16 stands for Thr, or Ile.
  VPU segment 3
XKLLXQRXIDRLIXRXRERAEDSGNESEGD

SEQ ID NO: 278 - DNA, 90 bp, Artificial
  VPU segment 4
  CDS (1)..(90)
ayaagggaaagggctgaggatagcggaaacgaaagcgaaggcgatasagaagagctcagcrcawtggtcgacatgggcaattacgatctg

SEQ ID NO: 279 - protein, 30 aa, Artificial
  misc_feature (1)..(1): The 'Xaa' at location 1 stands for Thr, or Ile.
  misc_feature (16)..(16): The 'Xaa' at location 16 stands for Arg, or Thr.
  misc_feature (21)..(21): The 'Xaa' at location 21 stands for Ala, or Thr.
  misc_feature (22)..(22): The 'Xaa' at location 22 stands for Met, or Leu.
  VPU segment 4
XRERAEDSGNESEGDXEELSXXVDMGNYDL

SEQ ID NO: 280 - DNA, 63 bp, Artificial
  VPU segment 6
  CDS (1)..(63)
asagaggaactgtccrccwtggtggatatgggaaactatgacctcggcgtcgacaataacctc

SEQ ID NO: 281 - protein, 21 aa, Artificial
  misc_feature (1)..(1): The 'Xaa' at location 1 stands for Arg, or Thr.
  misc_feature (6)..(6): The 'Xaa' at location 6 stands for Ala, or Thr.
  misc_feature (7)..(7): The 'Xaa' at location 7 stands for Met, or Leu.
  VPU segment 6
XEELSXXVDMGNYDLGVDNNL

SEQ ID NO: 282 - DNA, 90 bp, Artificial
  ENV segment 1
  CDS (1)..(90)
atgagagtgaaagagacacagatgaactggcccaatctgtggargtggggcacamtgattctgggamtggtcatsatttgctccgcctcc

SEQ ID NO: 283 - protein, 30 aa, Artificial
  misc_feature (15)..(15): The 'Xaa' at location 15 stands for Arg, or Lys.
  misc_feature (19)..(19): The 'Xaa' at location 19 stands for Met, or Leu.
  misc_feature (23)..(23): The 'Xaa' at location 23 stands for Met, or Leu.
  misc_feature (25)..(25): The 'Xaa' at location 25 stands for Met, or Ile.
  ENV segment 1
MRVKETQMNWPNLWXWGTXILGXVXICSAS

SEQ ID NO: 284 - DNA, 90 bp, Artificial
  ENV segment 2
  CDS (1)..(90)
tggggaaccwtgatcctcggcwtggtgatkatctgtagcgctagcgasaatctgtgggtgacagtgtattacggagtgcctgtgtggagg

SEQ ID NO: 285 - protein, 30 aa, Artificial
  misc_feature (4)..(4): The 'Xaa' at location 4 stands for Met, or Leu.
  misc_feature (8)..(8): The 'Xaa' at location 8 stands for Met, or Leu.
  misc_feature (10)..(10): The 'Xaa' at location 10 stands for Met, or Ile.
  misc_feature (16)..(16): The 'Xaa' at location 16 stands for Glu, or Asp.
  ENV segment 2
WGTXILGXVXICSASXNLWVTVYYGVPVWR

SEQ ID NO: 286 - DNA, 90 bp, Artificial
  ENV segment 3
  CDS (1)..(90)
gamaacctctgggtcaccgtctactatggcgtccccgtctggagagasgctrmcacaaccctcttctgtgcctccgacgctaaggctyac

SEQ ID NO: 287 - protein, 30 aa, Artificial
  misc_feature (1)..(1): The 'Xaa' at location 1 stands for Glu, or Asp.
  misc_feature (16)..(16): The 'Xaa' at location 16 stands for Glu, or Asp.
  misc_feature (18)..(18): The 'Xaa' at location 18 stands for Asp, Ala, Asn, or Thr.
  misc_feature (30)..(30): The 'Xaa' at location 30 stands for His, or Tyr.
  ENV segment 3
XNLWVTVYYGVPVWRXAXTTLFCASDAKAX

SEQ ID NO: 288 - DNA, 90 bp, Artificial
  ENV segment 4
  CDS (1)..(90)
gamgccrmtaccacactgttttgcgctagcgatgccaaagccyatgasacagaggtccacaatgtgtgggccacacacgcttgcgtcccc

SEQ ID NO: 289 - protein, 30 aa, Artificial
  misc_feature (1)..(1): The 'Xaa' at location 1 stands for Glu, or Asp.
  misc_feature (3)..(3): The 'Xaa' at location 3 stands for Asp, Ala, Asn, or Thr.
  misc_feature (15)..(15): The 'Xaa' at location 15 stands for His, or Tyr.
  misc_feature (16)..(16): The 'Xaa' at location 16 stands for Glu, or Asp.
  ENV segment 4
XAXTTLFCASDAKAXXTEVHNVWATHACVP

SEQ ID NO: 290 - DNA, 90 bp, Artificial
  ENV segment 5
  CDS (1)..(90)
gamaccgaagtgcataacgtctgggctacccatgcctgtgtgcctaccgatcccaatccccaagagrttswcctcgagaatgtgacagag

SEQ ID NO: 291 - protein, 30 aa, Artificial
  misc_feature (1)..(1): The 'Xaa' at location 1 stands for Glu, or Asp.
  misc_feature (23)..(23): The 'Xaa' at location 23 stands for Val, or Ile.
  misc_feature (24)..(24): The 'Xaa' at location 24 stands for Asp, Val, His, or Leu.
  ENV segment 5
XTEVHNVWATHACVPTDPNPQEXXLENVTE

SEQ ID NO: 292 - DNA, 90 bp, Artificial
  ENV segment 6
  CDS (1)..(90)
acagaccctaaccctcaggaartcswtctggaaaacgtcaccgaaaactttaacatgtggaaaaacratatggtcgascaaatgcawgag

SEQ ID NO: 293 - protein, 30 aa, Artificial
  misc_feature (8)..(8): The 'Xaa' at location 8 stands for Val, or Ile.
  misc_feature (9)..(9): The 'Xaa' at location 9 stands for Asp, Val, His, or Leu.
  misc_feature (23)..(23): The 'Xaa' at location 23 stands for Asp, or Asn.
  misc_feature (26)..(26): The 'Xaa' at location 26 stands for Glu, or Asp.
  misc_feature (29)..(29): The 'Xaa' at location 29 stands for Gln, or His.
  ENV segment 6
TDPNPQEXXLENVTENFNMWKNXMVXQMXE

SEQ ID NO: 294 - DNA, 90 bp, Artificial
  ENV segment 7
  CDS (1)..(90)
aatttcaatatgtggaagaatracatggtggamcagatgcamgaagacrttatctccctgtgggaccaaagcctcaagccttgcgtcaag

SEQ ID NO: 295 - protein, 30 aa, Artificial
  misc_feature (8)..(8): The 'Xaa' at location 8 stands for Asp, or Asn.
  misc_feature (11)..(11): The 'Xaa' at location 11 stands for Glu, or Asp.
  misc_feature (14)..(14): The 'Xaa' at location 14 stands for Gln, or His.
  misc_feature (17)..(17): The 'Xaa' at location 17 stands for Val, or Ile.
  ENV segment 7
NFNMWKNXMVXQMXEDXISLWDQSLKPCVK

SEQ ID NO: 296 - DNA, 90 bp, Artificial
  ENV segment 8
  CDS (1)..(90)
gatrtcattagcctctgggatcagtccctgaaaccctgtgtgaaactgacacccctctgcgtcaccctcaactgtaccaatgccaatctg

SEQ ID NO: 297 - protein, 30 aa, Artificial
  misc_feature (2)..(2): The 'Xaa' at location 2 stands for Val, or Ile.
  ENV segment 8
DXISLWDQSLKPCVKLTPLCVTLNCTNANL

SEQ ID NO: 298 - DNA, 57 bp, Artificial
  ENV segment 9
  CDS (1)..(57)
ctcacccctctgtgtgtgacactgaattgcacaaacgctaacctcatcaatgtgaat

SEQ ID NO: 299 - protein, 19 aa, Artificial
  ENV segment 9
LTPLCVTLNCTNANLINVN

SEQ ID NO: 300 - DNA, 90 bp, Artificial
  GAP A segment 1
  CDS (1)..(90)
tacagactgattarctgtaacacaagcgytatcamacaggcttgccctaagrttasctttgascctatccctatccattactgtrcccct

SEQ ID NO: 301 - protein, 30 aa, Artificial
  misc_feature (5)..(5): The 'Xaa' at location 5 stands for Ser, or Asn.
  misc_feature (10)..(10): The 'Xaa' at location 10 stands for Ala, or Val.
  misc_feature (12)..(12): The 'Xaa' at location 12 stands for Lys, or Thr.
  misc_feature (18)..(18): The 'Xaa' at location 18 stands for Val, or Ile.
  misc_feature (19)..(19): The 'Xaa' at location 19 stands for Ser, or Thr.
  misc_feature (21)..(21): The 'Xaa' at location 21 stands for Glu, or Asp.
  misc_feature (29)..(29): The 'Xaa' at location 29 stands for Ala, or Thr.
  GAP A segment 1
YRLIXCNTSXIXQACPKXXFXPIPIHYCXP

SEQ ID NO: 302 - DNA, 90 bp, Artificial
  GAP A segment 2
  CDS (1)..(90)
cccaaartcwccttcgamcccattcccattcactattgcrctcccgccggatwcgctatcctcaagtgtaacrataagammttcaatggc

SEQ ID NO: 303 - protein, 30 aa, Artificial
  misc_feature (3)..(3): The 'Xaa' at location 3 stands for Val, or Ile.
  misc_feature (4)..(4): The 'Xaa' at location 4 stands for Thr, or Ser.
  misc_feature (6)..(6): The 'Xaa' at location 6 stands for Glu, or Asp.
  misc_feature (14)..(14): The 'Xaa' at location 14 stands for Ala, or Thr.
  misc_feature (18)..(18): The 'Xaa' at location 18 stands for Tyr, or Phe.
  misc_feature (25)..(25): The 'Xaa' at location 25 stands for Asp, or Asn.
  misc_feature (27)..(27): The 'Xaa' at location 27 stands for Lys, Asn, or Thr.
  GAP A segment 2
PKXXFXPIPIHYCXPAGXAILKCNXKXFNG

SEQ ID NO: 304 - DNA, 90 bp, Artificial
  GAP A segment 3
  CDS (1)..(90)
gctggctwtgccattctgaaatgcaatracaaaamstttaacggaaccggaccctgtamgaatgtgtccascgtccagtgtacccatggc

SEQ ID NO: 305 - protein, 30 aa, Artificial
  misc_feature (3)..(3): The 'Xaa' at location 3 stands for Tyr, or Phe.
  misc_feature (10)..(10): The 'Xaa' at location 10 stands for Asp, or Asn.
  misc_feature (12)..(12): The 'Xaa' at location 12 stands for Lys, Asn, or Thr.
  misc_feature (20)..(20): The 'Xaa' at location 20 stands for Lys, or Thr.
  misc_feature (24)..(24): The 'Xaa' at location 24 stands for Ser, or Thr.
  GAP A segment 3
AGXAILKCNXKXFNGTGPCXNVSXVQCTHG

SEQ ID NO: 306 - DNA, 90 bp, Artificial
  GAP A segment 4
  CDS (1)..(90)
acaggcccttgcamaaacgtcagcwccgtgcaatgcacacacggaatcaracccgtcgtgtccacccaactgctcctgaatggctccctg

SEQ ID NO: 307 - protein, 30 aa, Artificial
  misc_feature (5)..(5): The 'Xaa' at location 5 stands for Lys, or Thr.
  misc_feature (9)..(9): The 'Xaa' at location 9 stands for Thr, or Ser.
  misc_feature (17)..(17): The 'Xaa' at location 17 stands for Arg, or Lys.
  GAP A segment 4
TGPCXNVSXVQCTHGIXPVVSTQLLLNGSL

SEQ ID NO: 308 - DNA, 90 bp, Artificial
  GAP A segment 5
  CDS (1)..(90)
attargcctgtggtcagcacacagctcctgctcaacggaagcctcgccgaagaggaartcrttatcagaagcgaaaacyttaccrataac

SEQ ID NO: 309 - protein, 30 aa, Artificial
  misc_feature (2)..(2): The 'Xaa' at location 2 stands for Arg, or Lys.
  misc_feature (20)..(20): The 'Xaa' at location 20 stands for Val, or Ile.
  misc_feature (21)..(21): The 'Xaa' at location 21 stands for Val, or Ile.
  misc_feature (27)..(27): The 'Xaa' at location 27 stands for Leu, or Phe.
  misc_feature (29)..(29): The 'Xaa' at location 29 stands for Asp, or Asn.
  GAP A segment 5
IXPVVSTQLLLNGSLAEEEXXIRSENXTXN

SEQ ID NO: 310 - DNA, 90 bp, Artificial
  GAP A segment 6
  CDS (1)..(90)
gctgaggaagatrttrtcattaggtccgagaatytcacaracaatgycaaaaccattatcgtccamctcaacraaagcgtcgwgattaac

SEQ ID NO: 311 - protein, 30 aa, Artificial
  misc_feature (5)..(5): The 'Xaa' at location 5 stands for Val, or Ile.
  misc_feature (6)..(6): The 'Xaa' at location 6 stands for Val, or Ile.
  misc_feature (12)..(12): The 'Xaa' at location 12 stands for Leu, or Phe.
  misc_feature (14)..(14): The 'Xaa' at location 14 stands for Asp, or Asn.
  misc_feature (16)..(16): The 'Xaa' at location 16 stands for Ala, or Val.
  misc_feature (22)..(22): The 'Xaa' at location 22 stands for Gln, or His.
  misc_feature (25)..(25): The 'Xaa' at location 25 stands for Glu, or Lys.
  misc_feature (28)..(28): The 'Xaa' at location 28 stands for Glu, or Val.
  GAP A segment 6
AEEDXXIRSENXTXNXKTIIVXLNXSVXIN

SEQ ID NO: 312 - DNA, 75 bp, Artificial
  GAP A segment 7
  CDS (1)..(75)
gytaagacaatcattgtgcawctgaatragtccgtggwaatcaattgcacaaggcctarcaataacacaaggama

SEQ ID NO: 313 - protein, 25 aa, Artificial
  misc_feature (1)..(1): The 'Xaa' at location 1 stands for Ala, or Val.
  misc_feature (7)..(7): The 'Xaa' at location 7 stands for Gln, or His.
  misc_feature (10)..(10): The 'Xaa' at location 10 stands for Glu, or Lys.
  misc_feature (13)..(13): The 'Xaa' at location 13 stands for Glu, or Val.
  misc_feature (20)..(20): The 'Xaa' at location 20 stands for Ser, or Asn.
  misc_feature (25)..(25): The 'Xaa' at location 25 stands for Lys, or Thr.
  GAP A segment 7
XKTIIVXLNXSVXINCTRPXNNTRX

SEQ ID NO: 314 - DNA, 90 bp, Artificial
  GAP B segment 1
  CDS (1)..(90)
ayctttaggcctggcggaggcratatsaragacaattggagaagcgaactgtataagtataaggtcgtgragattragcctctgggartc

SEQ ID NO: 315 - protein, 30 aa, Artificial
  misc_feature (1)..(1): The 'Xaa' at location 1 stands for Thr, or Ile.
  misc_feature (8)..(8): The 'Xaa' at location 8 stands for Asp, or Asn.
  misc_feature (9)..(9): The 'Xaa' at location 9 stands for Met, or Ile.
  misc_feature (10)..(10): The 'Xaa' at location 10 stands for Arg, or Lys.
  misc_feature (24)..(24): The 'Xaa' at location 24 stands for Glu, or Lys.
  misc_feature (26)..(26): The 'Xaa' at location 26 stands for Glu, or Lys.
  misc_feature (30)..(30): The 'Xaa' at location 30 stands for Val, or Ile.
  GAP B segment 1
XFRPGGGXXXDNWRSELYKYKVVXIXPLGX

SEQ ID NO: 316 - DNA, 90 bp, Artificial
  GAP B segment 2
  CDS (1)..(90)
gagctctacaaatacaaagtggtcraaatcraacccctcggcrttgcccctaccaragccaaaaggagagtggtcsagagagagaaaagg

SEQ ID NO: 317 - protein, 30 aa, Artificial
  misc_feature (9)..(9): The 'Xaa' at location 9 stands for Glu, or Lys.
  misc_feature (11)..(11): The 'Xaa' at location 11 stands for Glu, or Lys.
  misc_feature (15)..(15): The 'Xaa' at location 15 stands for Val, or Ile.
  misc_feature (19)..(19): The 'Xaa' at location 19 stands for Arg, or Lys.
  misc_feature (26)..(26): The 'Xaa' at location 26 stands for Glu, or Gln.
  GAP B segment 2
ELYKYKVVXIXPLGXAPTXAKRRVVXREKR

SEQ ID NO: 318 - DNA, 90 bp, Artificial
  GAP B segment 3
  CDS (1)..(90)
gctcccacaarggctaagagaagggtcgtgsaaagggaaaagagagccgtcggcmttggcgctatgwttytcggattcctcggcgctgcc

SEQ ID NO: 319 - protein, 30 aa, Artificial
  misc_feature (4)..(4): The 'Xaa' at location 4 stands for Arg, or Lys.
  misc_feature (11)..(11): The 'Xaa' at location 11 stands for Glu, or Gln.
  misc_feature (19)..(19): The 'Xaa' at location 19 stands for Ile, or Leu.
  misc_feature (23)..(23): The 'Xaa' at location 23 stands for Ile, or Phe.
  misc_feature (24)..(24): The 'Xaa' at location 24 stands for Leu, or Phe.
  GAP B segment 3
APTXAKRRVVXREKRAVGXGAMXXGFLGAA

SEQ ID NO: 320 - DNA, 90 bp, Artificial
  GAP B segment 4
  CDS (1)..(90)
gctgtgggamtcggagccatgwtcyttggctttctgggagccgctggctccaccatgggcgctgcctccatsacactgacagtgcaagcc

SEQ ID NO: 321 - protein, 30 aa, Artificial
  misc_feature (4)..(4): The 'Xaa' at location 4 stands for Ile, or Leu.
  misc_feature (8)..(8): The 'Xaa' at location 8 stands for Ile, or Phe.
  misc_feature (9)..(9): The 'Xaa' at location 9 stands for Leu, or Phe.
  misc_feature (24)..(24): The 'Xaa' at location 24 stands for Met, or Ile.
  GAP B segment 4
AVGXGAMXXGFLGAAGSTMGAASXTLTVQA

SEQ ID NO: 322 - DNA, 90 bp, Artificial
  GAP B segment 5
  CDS (1)..(90)
ggaagcacaatgggagccgctagcatkaccctcaccgtccaggctaggcwactgctcagcggaatcgtccagcaacagarcaatctgctc

SEQ ID NO: 323 - protein, 30 aa, Artificial
  misc_feature (9)..(9): The 'Xaa' at location 9 stands for Met, or Ile.
  misc_feature (17)..(17): The 'Xaa' at location 17 stands for Gln, or Leu.
  misc_feature (27)..(27): The 'Xaa' at location 27 stands for Ser, or Asn.
  GAP B segment 5
GSTMGAASXTLTVQARXLLSGIVQQQXNLL

SEQ ID NO: 324 - DNA, 90 bp, Artificial
  GAP B segment 6
  CDS (1)..(90)
agacwgctcctgtccggcattgtgcaacagcaaartaacctcctgagggctatcgaagcccaacagcatmtgctccagctcaccgtctgg

SEQ ID NO: 325 - protein, 30 aa, Artificial
  misc_feature (2)..(2): The 'Xaa' at location 2 stands for Gln, or Leu.
  misc_feature (12)..(12): The 'Xaa' at location 12 stands for Ser, or Asn.
  misc_feature (24)..(24): The 'Xaa' at location 24 stands for Met, or Leu.
  GAP B segment 6
RXLLSGIVQQQXNLLRAIEAQQHXLQLTVW

SEQ ID NO: 326 - DNA, 90 bp, Artificial
  GAP B segment 7
  CDS (1)..(90)
agagccattgaggctcagcaacacwtgctgcaactgacagtgtggggcattaagcaactgcaagccagagtgctcgccrttgagagatac

SEQ ID NO: 327 - protein, 30 aa, Artificial
  misc_feature (9)..(9): The 'Xaa' at location 9 stands for Met, or Leu.
  misc_feature (27)..(27): The 'Xaa' at location 27 stands for Val, or Ile.
  GAP B segment 7
RAIEAQQHXLQLTVWGIKQLQARVLAXERY

SEQ ID NO: 328 - DNA, 90 bp, Artificial
  GAP B segment 8
  CDS (1)..(90)
ggaatcaaacagctccaggctagggtcctggctrtcgaaaggtatctgaaagaccaamagyttctgggamtctggggctgtagcggaaag

SEQ ID NO: 329 - protein, 30 aa, Artificial
  misc_feature (12)..(12): The 'Xaa' at location 12 stands for Val, or Ile.
  misc_feature (20)..(20): The 'Xaa' at location 20 stands for Lys, or Gln.
  misc_feature (21)..(21): The 'Xaa' at location 21 stands for Leu, or Phe.
  misc_feature (24)..(24): The 'Xaa' at location 24 stands for Ile, or Leu.
  GAP B segment 8
GIKQLQARVLAXERYLKDQXXLGXWGCSGK

SEQ ID NO: 330 - DNA, 90 bp, Artificial
  GAP B segment 9
  CDS (1)..(90)
ctcaaggatcagmaaytcctcggcmtttggggatgctccggcaaamtcatttgcacaaccrmtgtgccttggaacagcwcctggtccaac

SEQ ID NO: 331 - protein, 30 aa, Artificial
  misc_feature (5)..(5): The 'Xaa' at location 5 stands for Lys, or Gln.
  misc_feature (6)..(6): The 'Xaa' at location 6 stands for Leu, or Phe.
  misc_feature (9)..(9): The 'Xaa' at location 9 stands for Ile, or Leu.
  misc_feature (16)..(16): The 'Xaa' at location 16 stands for Ile, or Leu.
  misc_feature (21)..(21): The 'Xaa' at location 21 stands for Asp, Ala, Asn, or Thr.
  misc_feature (27)..(27): The 'Xaa' at location 27 stands for Thr, or Ser.
  GAP B segment 9
LKDQXXLGXWGCSGKXICTTXVPWNSXWSN

SEQ ID NO: 332 - DNA, 90 bp, Artificial
  GAP B segment 10
  CDS (1)..(90)
mttatctgtaccacarmcgtcccctggaattccasctggagcaataagtccytcgaagagatttggrataacatgacctggatssaatgg

SEQ ID NO: 333 - protein, 30 aa, Artificial
  misc_feature (1)..(1): The 'Xaa' at location 1 stands for Ile, or Leu.
  misc_feature (6)..(6): The 'Xaa' at location 6 stands for Asp, Ala, Asn, or Thr.
  misc_feature (12)..(12): The 'Xaa' at location 12 stands for Ser, or Thr.
  misc_feature (18)..(18): The 'Xaa' at location 18 stands for Leu, or Phe.
  misc_feature (23)..(23): The 'Xaa' at location 23 stands for Asp, or Asn.
  misc_feature (28)..(28): The 'Xaa' at location 28 stands for Met, or Ile.
  misc_feature (29)..(29): The 'Xaa' at location 29 stands for Glu, or Gln.
  GAP B segment 10
XICTTXVPWNSXWSNKSXEEIWXNMTWXXW

SEQ ID NO: 334 - DNA, 90 bp, Artificial
  GAP B segment 11
  CDS (1)..(90)
aaaagcyttgaggaaatctggracaatatgacatggatksagtgggagagagagattagcaattacacaarccwaatctatragattctg

SEQ ID NO: 335 - protein, 30 aa, Artificial
  misc_feature (3)..(3): The 'Xaa' at location 3 stands for Leu, or Phe.
  misc_feature (8)..(8): The 'Xaa' at location 8 stands for Asp, or Asn.
  misc_feature (13)..(13): The 'Xaa' at location 13 stands for Met, or Ile.
  misc_feature (14)..(14): The 'Xaa' at location 14 stands for Glu, or Gln.
  misc_feature (24)..(24): The 'Xaa' at location 24 stands for Ser, or Asn.
  misc_feature (25)..(25): The 'Xaa' at location 25 stands for Gln, or Leu.
  misc_feature (28)..(28): The 'Xaa' at location 28 stands for Glu, or Lys.
  GAP B segment 11
KSXEEIWXNMTWXXWEREISNYTXXIYXIL

SEQ ID NO: 336 - DNA, 90 bp, Artificial
  GAP B segment 12
  CDS (1)..(90)
gaaagggaaatctccaactataccartcwgatttacraaatcctcaccgaaagccaaaaccaacaggataggaatgagmaagasctcctg

SEQ ID NO: 337 - protein, 30 aa, Artificial
  misc_feature (9)..(9): The 'Xaa' at location 9 stands for Ser, or Asn.
  misc_feature (10)..(10): The 'Xaa' at location 10 stands for Gln, or Leu.
  misc_feature (13)..(13): The 'Xaa' at location 13 stands for Glu, or Lys.
  misc_feature (27)..(27): The 'Xaa' at location 27 stands for Lys, or Gln.
  misc_feature (28)..(28): The 'Xaa' at location 28 stands for Glu, or Asp.
  GAP B segment 12
EREISNYTXXIYXILTESQNQQDRNEXXLL

SEQ ID NO: 338 - DNA, 90 bp, Artificial
  GAP B segment 13
  CDS (1)..(90)
acagagtcccagaatcagcaagacagaaacgaamaggamctgctcgmgctcgacaaatgggctagcctctggaattggtttracattasc

SEQ ID NO: 339 - protein, 30 aa, Artificial
  misc_feature (12)..(12): The 'Xaa' at location 12 stands for Lys, or Gln.
  misc_feature (13)..(13): The 'Xaa' at location 13 stands for Glu, or Asp.
  misc_feature (16)..(16): The 'Xaa' at location 16 stands for Glu, or Ala.
  misc_feature (28)..(28): The 'Xaa' at location 28 stands for Asp, or Asn.
  misc_feature (30)..(30): The 'Xaa' at location 30 stands for Ser, or Thr.
  GAP B segment 13
TESQNQQDRNEXXLLXLDKWASLWNWFXIX

SEQ ID NO: 340 - DNA, 90 bp, Artificial
  GAP B segment 14
  CDS (1)..(90)
gmactggataagtgggcctccctgtggaactggttcratatcwccaastggctgtggtacattaagattttcattatgattgtgggaggc

SEQ ID NO: 341 - protein, 30 aa, Artificial
  misc_feature (1)..(1): The 'Xaa' at location 1 stands for Glu, or Ala.
  misc_feature (13)..(13): The 'Xaa' at location 13 stands for Asp, or Asn.
  misc_feature (15)..(15): The 'Xaa' at location 15 stands for Thr, or Ser.
  misc_feature (16)..(16): The 'Xaa' at location 16 stands for Lys, or Asn.
  GAP B segment 14
XLDKWASLWNWFXIXXWLWYIKIFIMIVGG

SEQ ID NO: 342 - DNA, 90 bp, Artificial
  GAP B segment 15
  CDS (1)..(90)
aamtggctctggtatatcaaaatctttatcatgatcgtcggcggactgrttggcctcaggattrtctttgccgtcctgtccatcrttaac

SEQ ID NO: 343 - protein, 30 aa, Artificial
  misc_feature (1)..(1): The 'Xaa' at location 1 stands for Lys, or Asn.
  misc_feature (17)..(17): The 'Xaa' at location 17 stands for Val, or Ile.
  misc_feature (22)..(22): The 'Xaa' at location 22 stands for Val, or Ile.
  misc_feature (29)..(29): The 'Xaa' at location 29 stands for Val, or Ile.
  GAP B segment 15
XWLWYIKIFIMIVGGLXGLRIXFAVLSIXN

SEQ ID NO: 344 - DNA, 90 bp, Artificial
  GAP B segment 16
  CDS (1)..(90)
ctcrtcggactgagaatcrttttcgctgtgctcagcattrtcaatagggtcaggcaaggctatagccctctgtccttccaaaccctcmyc

SEQ ID NO: 345 - protein, 30 aa, Artificial
  misc_feature (2)..(2): The 'Xaa' at location 2 stands for Val, or Ile.
  misc_feature (7)..(7): The 'Xaa' at location 7 stands for Val, or Ile.
  misc_feature (14)..(14): The 'Xaa' at location 14 stands for Val, or Ile.
  misc_feature (30)..(30): The 'Xaa' at location 30 stands for Thr, Ile, Pro, or Leu.
  GAP B segment 16
LXGLRIXFAVLSIXNRVRQGYSPLSFQTLX

SEQ ID NO: 346 - DNA, 90 bp, Artificial
  GAP B segment 17
  CDS (1)..(90)
agagtgagacagggatactcccccctcagctttcagacactgmygcccgctcccagaggccctgacagacycgrasgcattgaggaagag

SEQ ID NO: 347 - protein, 30 aa, Artificial
  misc_feature (15)..(15): The 'Xaa' at location 15 stands for Thr, Met, Pro, or Leu.
  misc_feature (24)..(24): The 'Xaa' at location 24 stands for Pro, or Leu.
  misc_feature (25)..(25): The 'Xaa' at location 25 stands for Gly, or Glu.
  misc_feature (26)..(26): The 'Xaa' at location 26 stands for Gly, or Arg.
  GAP B segment 17
RVRQGYSPLSFQTLXPAPRGPDRXXXIEEE

SEQ ID NO: 348 - DNA, 90 bp, Artificial
  GAP B segment 18
  CDS (1)..(90)
cctgcccctaggggacccgataggcyggrgrgaatcgaagaggaaggcggagagcragrcagagrcagaagcgtcaggctcgtgartggc

SEQ ID NO: 349 - protein, 30 aa, Artificial
  misc_feature (9)..(9): The 'Xaa' at location 9 stands for Pro, or Leu.
  misc_feature (10)..(10): The 'Xaa' at location 10 stands for Gly, or Glu.
  misc_feature (11)..(11): The 'Xaa' at location 11 stands for Gly, or Arg.
  misc_feature (19)..(19): The 'Xaa' at location 19 stands for Arg, or Gln.
  misc_feature (20)..(20): The 'Xaa' at location 20 stands for Gly, or Asp.
  misc_feature (22)..(22): The 'Xaa' at location 22 stands for Gly, or Asp.
  misc_feature (29)..(29): The 'Xaa' at location 29 stands for Ser, or Asn.
  GAP B segment 18
PAPRGPDRXXXIEEEGGEXXRXRSVRLVXG

SEQ ID NO: 350 - DNA, 90 bp, Artificial
  GAP B segment 19
  CDS (1)..(90)
ggaggcgaacrggrtagggrtaggtccgtgagactggtcarcggattctyagccctcgcctgggacgatctgagaarcctctgcctcttc

SEQ ID NO: 351 - protein, 30 aa, Artificial
  misc_feature (4)..(4): The 'Xaa' at location 4 stands for Arg, or Gln.
  misc_feature (5)..(5): The 'Xaa' at location 5 stands for Gly, or Asp.
  misc_feature (7)..(7): The 'Xaa' at location 7 stands for Gly, or Asp.
  misc_feature (14)..(14): The 'Xaa' at location 14 stands for Ser, or Asn.
  misc_feature (17)..(17): The 'Xaa' at location 17 stands for Ser, or Leu.
  misc_feature (26)..(26): The 'Xaa' at location 26 stands for Ser, or Asn.
  GAP B segment 19
GGEXXRXRSVRLVXGFXALAWDDLRXLCLF

SEQ ID NO: 352 - DNA, 90 bp, Artificial
  GAP B segment 20
  CDS (1)..(90)
ttttyggctctggcttgggatgacctcaggartctgtgtctgtttagctatcacagactgagagacyttatcctcatcgytgccagaayc

SEQ ID NO: 353 - protein, 30 aa, Artificial
  misc_feature (2)..(2): The 'Xaa' at location 2 stands for Ser, or Leu.
  misc_feature (11)..(11): The 'Xaa' at location 11 stands for Ser, or Asn.
  misc_feature (23)..(23): The 'Xaa' at location 23 stands for Leu, or Phe.
  misc_feature (27)..(27): The 'Xaa' at location 27 stands for Ala, or Val.
  misc_feature (30)..(30): The 'Xaa' at location 30 stands for Thr, or Ile.
  GAP B segment 20
FXALAWDDLRXLCLFSYHRLRDXILIXARX

SEQ ID NO: 354 - DNA, 90 bp, Artificial
  GAP B segment 21
  CDS (1)..(90)
tcctaccataggctcagggatytcattctgattgycgctaggaytgtggaactgctcggccrtagctccctgaraggcctccrgagaggc

SEQ ID NO: 355 - protein, 30 aa, Artificial
  misc_feature (8)..(8): The 'Xaa' at location 8 stands for Leu, or Phe.
  misc_feature (12)..(12): The 'Xaa' at location 12 stands for Ala, or Val.
  misc_feature (15)..(15): The 'Xaa' at location 15 stands for Thr, or Ile.
  misc_feature (21)..(21): The 'Xaa' at location 21 stands for Arg, or His.
  misc_feature (25)..(25): The 'Xaa' at location 25 stands for Arg, or Lys.
  misc_feature (28)..(28): The 'Xaa' at location 28 stands for Arg, or Gln.
  GAP B segment 21
SYHRLRDXILIXARXVELLGXSSLXGLXRG

SEQ ID NO: 356 - DNA, 90 bp, Artificial
  GAP B segment 22
  CDS (1)..(90)
gtcgagctcctgggacrctccagcctcargggactgcraaggggatgggaagscctcaagtattkgkggaacctcctgcwatattgggga

SEQ ID NO: 357 - protein, 30 aa, Artificial
  misc_feature (6)..(6): The 'Xaa' at location 6 stands for Arg, or His.
  misc_feature (10)..(10): The 'Xaa' at location 10 stands for Arg, or Lys.
  misc_feature (13)..(13): The 'Xaa' at location 13 stands for Arg, or Gln.
  misc_feature (18)..(18): The 'Xaa' at location 18 stands for Gly, or Ala.
  misc_feature (22)..(22): The 'Xaa' at location 22 stands for Trp, or Leu.
  misc_feature (23)..(23): The 'Xaa' at location 23 stands for Gly, or Trp.
  misc_feature (27)..(27): The 'Xaa' at location 27 stands for Gln, or Leu.
  GAP B segment 22
VELLGXSSLXGLXRGWEXLKYXXNLLXYWG

SEQ ID NO: 358 - DNA, 90 bp, Artificial
  GAP B segment 23
  CDS (1)..(90)
tgggaggstctgaaatactkgkggaatctgctccwgtactggggccwggaactgaaaawctccgccrttagcctcctgaatgccacagcc

SEQ ID NO: 359 - protein, 30 aa, Artificial
  misc_feature (3)..(3): The 'Xaa' at location 3 stands for Gly, or Ala.
  misc_feature (7)..(7): The 'Xaa' at location 7 stands for Trp, or Leu.
  misc_feature (8)..(8): The 'Xaa' at location 8 stands for Gly, or Trp.
  misc_feature (12)..(12): The 'Xaa' at location 12 stands for Gln, or Leu.
  misc_feature (16)..(16): The 'Xaa' at location 16 stands for Gln, or Leu.
  misc_feature (20)..(20): The 'Xaa' at location 20 stands for Asn, or Ile.
  misc_feature (23)..(23): The 'Xaa' at location 23 stands for Val, or Ile.
  GAP B segment 23
WEXLKYXXNLLXYWGXELKXSAXSLLNATA

SEQ ID NO: 360 - DNA, 90 bp, Artificial
  GAP B segment 24
  CDS (1)..(90)
cwagagctcaagawtagcgctrtctccctgctcaacgctaccgctatcgctgtggctgrgkggaccgataggrttatcgaagtggytcag

SEQ ID NO: 361 - protein, 30 aa, Artificial
  misc_feature (1)..(1): The 'Xaa' at location 1 stands for Gln, or Leu.
  misc_feature (5)..(5): The 'Xaa' at location 5 stands for Asn, or Ile.
  misc_feature (8)..(8): The 'Xaa' at location 8 stands for Val, or Ile.
  misc_feature (20)..(20): The 'Xaa' at location 20 stands for Gly, or Glu.
  misc_feature (21)..(21): The 'Xaa' at location 21 stands for Gly, or Trp.
  misc_feature (25)..(25): The 'Xaa' at location 25 stands for Val, or Ile.
  misc_feature (29)..(29): The 'Xaa' at location 29 stands for Ala, or Val.
  GAP B segment 24
XELKXSAXSLLNATAIAVAXXTDRXIEVXQ

SEQ ID NO: 362 - DNA, 90 bp, Artificial
  GAP B segment 25
  CDS (1)..(90)
attgccgtcgccgrakggacagacagartcattgaggtcgyccaaagggctkggagagccattctgmatatccctasaagaatcagacag

SEQ ID NO: 363 - protein, 30 aa, Artificial
  misc_feature (5)..(5): The 'Xaa' at location 5 stands for Gly, or Glu.
  misc_feature (6)..(6): The 'Xaa' at location 6 stands for Gly, or Trp.
  misc_feature (10)..(10): The 'Xaa' at location 10 stands for Val, or Ile.
  misc_feature (14)..(14): The 'Xaa' at location 14 stands for Ala, or Val.
  misc_feature (18)..(18): The 'Xaa' at location 18 stands for Gly, or Trp.
  misc_feature (23)..(23): The 'Xaa' at location 23 stands for Asn, or His.
  misc_feature (26)..(26): The 'Xaa' at location 26 stands for Arg, or Thr.
  GAP B segment 25
IAVAXXTDRXIEVXQRAXRAILXIPXRIRQ

SEQ ID NO: 364 - DNA, 66 bp, Artificial
  GAP B segment 26
  CDS (1)..(66)
agagcckggagggctatcctcmacattcccasgaggattaggcaaggcyttgagagagccctcctg

SEQ ID NO: 365 - protein, 22 aa, Artificial
  misc_feature (3)..(3): The 'Xaa' at location 3 stands for Gly, or Trp.
  misc_feature (8)..(8): The 'Xaa' at location 8 stands for Asn, or His.
  misc_feature (11)..(11): The 'Xaa' at location 11 stands for Arg, or Thr.
  misc_feature (17)..(17): The 'Xaa' at location 17 stands for Leu, or Phe.
  GAP B segment 26
RAXRAILXIPXRIRQGXERALL

SEQ ID NO: 366 - DNA, 90 bp, Artificial
  NEF segment 1
  CDS (1)..(90)
atgggaggcaaatggtccaagwgctcccycgtcggatggcccgmagtgagagagagaatcagacrgrcascccctgccgctgagggagtg

SEQ ID NO: 367 - protein, 30 aa, Artificial
  misc_feature (8)..(8): The 'Xaa' at location 8 stands for Ser, or Cys.
  misc_feature (10)..(10): The 'Xaa' at location 10 stands for Pro, or Leu.
  misc_feature (15)..(15): The 'Xaa' at location 15 stands for Glu, or Ala.
  misc_feature (22)..(22): The 'Xaa' at location 22 stands for Arg, or Gln.
  misc_feature (23)..(23): The 'Xaa' at location 23 stands for Ala, or Thr.
  misc_feature (24)..(24): The 'Xaa' at location 24 stands for Ala, or Pro.
  NEF segment 1
MGGKWSKXSXVGWPXVRERIRXXXPAAEGV

SEQ ID NO: 368 - DNA, 90 bp, Artificial
  NEF segment 2
  CDS (1)..(90)
gtcagggaaaggattaggcrarccsctcccgctgccgaaggcgtcggcgctgyctcccrggatctggataagkacggagccmtcacctcc

SEQ ID NO: 369 - protein, 30 aa, Artificial
  misc_feature (7)..(7): The 'Xaa' at location 7 stands for Arg, or Gln.
  misc_feature (8)..(8): The 'Xaa' at location 8 stands for Ala, or Thr.
  misc_feature (9)..(9): The 'Xaa' at location 9 stands for Ala, or Pro.
  misc_feature (18)..(18): The 'Xaa' at location 18 stands for Ala, or Val.
  misc_feature (20)..(20): The 'Xaa' at location 20 stands for Arg, or Gln.
  misc_feature (25)..(25): The 'Xaa' at location 25 stands for Asp, or Tyr.
  misc_feature (28)..(28): The 'Xaa' at location 28 stands for Ile, or Leu.
  NEF segment 2
VRERIRXXXPAAEGVGAXSXDLDKXGAXTS

SEQ ID NO: 370 - DNA, 90 bp, Artificial
  NEF segment 3
  CDS (1)..(90)
ggagccgygagccragacctcgacaaakatggcgctmttacaagctccaataccsctgccaataacsctgactgtgyctggctcraggct

SEQ ID NO: 371 - protein, 30 aa, Artificial
  misc_feature (3)..(3): The 'Xaa' at location 3 stands for Ala, or Val.
  misc_feature (5)..(5): The 'Xaa' at location 5 stands for Arg, or Gln.
  misc_feature (10)..(10): The 'Xaa' at location 10 stands for Asp, or Tyr.
  misc_feature (13)..(13): The 'Xaa' at location 13 stands for Ile, or Leu.
  misc_feature (19)..(19): The 'Xaa' at location 19 stands for Ala, or Pro.
  misc_feature (23)..(23): The 'Xaa' at location 23 stands for Ala, or Pro.
  misc_feature (26)..(26): The 'Xaa' at location 26 stands for Ala, or Val.
  misc_feature (29)..(29): The 'Xaa' at location 29 stands for Glu, or Lys.
  NEF segment 3
GAXSXDLDKXGAXTSSNTXANNXDCXWLXA

SEQ ID NO: 372 - DNA, 90 bp, Artificial
  NEF segment 4
  CDS (1)..(90)
agcaacacasccgctaacaatsccgattgcgygtggctgraagcccaggaagaggaagragtgggatttcctgtgagaccccaagtgcct

SEQ ID NO: 373 - protein, 30 aa, Artificial
  misc_feature (4)..(4): The 'Xaa' at location 4 stands for Ala, or Pro.
  misc_feature (8)..(8): The 'Xaa' at location 8 stands for Ala, or Pro.
  misc_feature (11)..(11): The 'Xaa' at location 11 stands for Ala, or Val.
  misc_feature (14)..(14): The 'Xaa' at location 14 stands for Glu, or Lys.
  misc_feature (20)..(20): The 'Xaa' at location 20 stands for Gly, or Glu.
  NEF segment 4
SNTXANNXDCXWLXAQEEEXVGFPVRPQVP

SEQ ID NO: 374 - DNA, 90 bp, Artificial
  NEF segment 5
  CDS (1)..(90)
caagaggaagaggrggtcggcttccccgtcaggcctcaggtccccctgagacctatgacctacaaagsagccrtcgatctgtccytcttc

SEQ ID NO: 375 - protein, 30 aa, Artificial
  misc_feature (5)..(5): The 'Xaa' at location 5 stands for Gly, or Glu.
  misc_feature (23)..(23): The 'Xaa' at location 23 stands for Gly, or Ala.
  misc_feature (25)..(25): The 'Xaa' at location 25 stands for Val, or Ile.
  misc_feature (29)..(29): The 'Xaa' at location 29 stands for Leu, or Phe.
  NEF segment 5
QEEEXVGFPVRPQVPLRPMTYKXAXDLSXF

SEQ ID NO: 376 - DNA, 90 bp, Artificial
  NEF segment 6
  CDS (1)..(90)
ctcaggcccatgacatataaggscgctrttgacctcagcytgtttctgaaagagaaaggcggactggawggcctcrtctatagcmagaaa

SEQ ID NO: 377 - protein, 30 aa, Artificial
  misc_feature (8)..(8): The 'Xaa' at location 8 stands for Gly, or Ala.
  misc_feature (10)..(10): The 'Xaa' at location 10 stands for Val, or Ile.
  misc_feature (14)..(14): The 'Xaa' at location 14 stands for Leu.
  misc_feature (23)..(23): The 'Xaa' at location 23 stands for Glu, or Asp.
  misc_feature (26)..(26): The 'Xaa' at location 26 stands for Val, or Ile.
  misc_feature (29)..(29): The 'Xaa' at location 29 stands for Lys, or Gln.
  NEF segment 6
LRPMTYKXAXDLSXFLKEKGGLXGLXYSXK

SEQ ID NO: 378 - DNA, 90 bp, Artificial
  NEF segment 7
  CDS (1)..(90)
ctcaaggaaaagggaggcctcgasggactgrtttactccmaaaagaggcaagasattctggatctgtgggtgtatmacacacagggatwc

SEQ ID NO: 379 - protein, 30 aa, Artificial
  misc_feature (8)..(8): The 'Xaa' at location 8 stands for Glu, or Asp.
  misc_feature (11)..(11): The 'Xaa' at location 11 stands for Val, or Ile.
  misc_feature (14)..(14): The 'Xaa' at location 14 stands for Lys, or Gln.
  misc_feature (18)..(18): The 'Xaa' at location 18 stands for Glu, or Asp.
  misc_feature (26)..(26): The 'Xaa' at location 26 stands for Asn, or His.
  misc_feature (30)..(30): The 'Xaa' at location 30 stands for Tyr, or Phe.
  NEF segment 7
LKEKGGLXGLXYSXKRQXILDLWVYXTQGX

SEQ ID NO: 380 - DNA, 90 bp, Artificial
  NEF segment 8
  CDS (1)..(90)
agacaggawatcctcgatctctgggtctacmatacccaaggctwtttccctgactggcasaattacacacccggacccggarycagatac

SEQ ID NO: 381 - protein, 30 aa, Artificial
  misc_feature (3)..(3): The 'Xaa' at location 3 stands for Glu, or Asp.
  misc_feature (11)..(11): The 'Xaa' at location 11 stands for Asn, or His.
  misc_feature (15)..(15): The 'Xaa' at location 15 stands for Tyr, or Phe.
  misc_feature (20)..(20): The 'Xaa' at location 20 stands for Gln, or His.
  misc_feature (28)..(28): The 'Xaa' at location 28 stands for Ala, Val, Thr, or Ile.
  NEF segment 8
RQXILDLWVYXTQGXFPDWXNYTPGPGXRY

SEQ ID NO: 382 - DNA, 90 bp, Artificial
  NEF segment 9
  CDS (1)..(90)
tttcccgattggcawaactatacccctggccctggcryaaggtatcccctcacctttggctggtgctttaagctcgtgcctgtggatccc

SEQ ID NO: 383 - protein, 30 aa, Artificial
  misc_feature (5)..(5): The 'Xaa' at location 5 stands for Gln, or His.
  misc_feature (13)..(13): The 'Xaa' at location 13 stands for Ala, Val, Thr, or Ile.
  NEF segment 9
FPDWXNYTPGPGXRYPLTFGWCFKLVPVDP

SEQ ID NO: 384 - DNA, 90 bp, Artificial
  NEF segment 10
  CDS (1)..(90)
cctctgacattcggatggtgtttcaaactggtccccgtcgaccctagsgaagtggaagagrycaacraaggcgaaaacaattgcctcctg

SEQ ID NO: 385 - protein, 30 aa, Artificial
  misc_feature (16)..(16): The 'Xaa' at location 16 stands for Arg, or Ser.
  misc_feature (21)..(21): The 'Xaa' at location 21 stands for Ala, Val, Thr, or Ile.
  misc_feature (23)..(23): The 'Xaa' at location 23 stands for Glu, or Lys.
  NEF segment 10
PLTFGWCFKLVPVDPXEVEEXNXGENNCLL

SEQ ID NO: 386 - DNA, 90 bp, Artificial
  NEF segment 11
  CDS (1)..(90)
agwgaggtcgaggaarycaatragggagagaataactgtctgctccaccctatsrgtcwgcatggcatggaagacgaagasagagaggtc

SEQ ID NO: 387 - protein, 30 aa, Artificial
  misc_feature (1)..(1): The 'Xaa' at location 1 stands for Arg, or Ser.
  misc_feature (6)..(6): The 'Xaa' at location 6 stands for Ala, Val, Thr, or Ile.
  misc_feature (8)..(8): The 'Xaa' at location 8 stands for Glu, or Lys.
  misc_feature (18)..(18): The 'Xaa' at location 18 stands for Met, or Ile.
  misc_feature (19)..(19): The 'Xaa' at location 19 stands for Gly, or Ser.
  misc_feature (20)..(20): The 'Xaa' at location 20 stands for Gln, or Leu.
  misc_feature (27)..(27): The 'Xaa' at location 27 stands for Glu, or Asp.
  NEF segment 11
XEVEEXNXGENNCLLHPXXXHGMEDEXREV

SEQ ID NO: 388 - DNA, 90 bp, Artificial
  NEF segment 12
  CDS (1)..(90)
catcccatsrgccwacacggaatggaggatgaggawagggaagtgctgawatggaaattcgatagccrtctggctckcaggcatatsgct

SEQ ID NO: 389 - protein, 30 aa, Artificial
  misc_feature (3)..(3): The 'Xaa' at location 3 stands for Met, or Ile.
  misc_feature (4)..(4): The 'Xaa' at location 4 stands for Gly, or Ser.
  misc_feature (5)..(5): The 'Xaa' at location 5 stands for Gln, or Leu.
  misc_feature (12)..(12): The 'Xaa' at location 12 stands for Glu, or Asp.
  misc_feature (17)..(17): The 'Xaa' at location 17 stands for Lys, or Ile.
  misc_feature (23)..(23): The 'Xaa' at location 23 stands for Arg, or His.
  misc_feature (26)..(26): The 'Xaa' at location 26 stands for Arg, or Leu.
  misc_feature (29)..(29): The 'Xaa' at location 29 stands for Met, or Ile.
  NEF segment 12
HPXXXHGMEDEXREVLXWKFDSXLAXRHXA

SEQ ID NO: 390 - DNA, 78 bp, Artificial
  NEF segment 13
  CDS (1)..(78)
ctcawatggaagtttgactcccrcctcgccckgagacatatsgccagggaactgcrtcccgaatwctacaaagactgc

SEQ ID NO: 391 - protein, 26 aa, Artificial
  misc_feature (2)..(2): The 'Xaa' at location 2 stands for Lys, or Ile.
  misc_feature (8)..(8): The 'Xaa' at location 8 stands for Arg, or His.
  misc_feature (11)..(11): The 'Xaa' at location 11 stands for Arg, or Leu.
  misc_feature (14)..(14): The 'Xaa' at location 14 stands for Met, or Ile.
  misc_feature (19)..(19): The 'Xaa' at location 19 stands for Arg, or His.
  misc_feature (22)..(22): The 'Xaa' at location 22 stands for Tyr, or Phe.
  NEF segment 13
LXWKFDSXLAXRHXARELXPEXYKDC

SEQ ID NO: 392 - DNA, 5703 bp, Artificial
  HIV cassette A1
  CDS (1)..(5688)
ggatccaccatgacaggcccttgcacaaacgtcagcaccgtgcaatgcacacacggaatcagacccgtcgtgtccacccaactgctcctgaatggctccctgagaagcctctacaataccgtcgccacactgtggtgcgtccaccaaaggattgacgtcagggacacaaaggaagccctcgacaaaatcgaactcggcgatggcggaggcgctgaaaggcaaggcacctccagctccttcaactttccacaaatcacactgtggcaaaggcctctggtcaccgaacccttcagaaaaaagaatcccgatatggtgatttaccagtacatggacgatctgtatgtgggaagcgatctggaaatcggacagcattttaccacacccgataagaaacaccaaaaggaaccaccattcctctggatgggatacgaactgcatcccgataggtggaccgtccagcctcttaatttccctcagattaccctctggcagcgtcccctcgtgacaatcaaaatcggcggacagctcatagaggctctgctcgacacaggctcctatggcagaaagaaacgtaggcaacgtagacgcgctcctcagagcagcaaggatcaccaataccctatctctgagcaacccctctccttctttagggaaaacctggctttccagcaaggtaaagccagagagttttccagcgaacagacaagagccaatagctccgcctccaggaagagcccccaaatctccggcgaaagctccgtcattctgggatctggcaccaaaaacgccgctactagaagaatcgaagtgaaagataccaaagaggctttggataagattgaggaggtgcaaaagaaaagcgagcaaaagacacaacaggctgccgctaaagccggatacgtcaccgataggggaaggcaaaagattatctccctgacagagacaaccaatcagaaaaccgaactgcatgccattcaagaagccactaccacactgttttgcgccagcgatgccaaagcctatgagacagaggtccacaatgtgtgggccacacacgcttgcgtccccgctgacgatacagtgctggaggagatgaacctccccggaaaatggaagcctaagatgattggcggaatcggcggattcattaaggtgagaaaaatcggacccgaaaacccttacaataccccaatcttcgctatcaagaaaaaggactccaccaaatggagaaagctcgtggatttcagagttaggattatcaatatcctctaccaaagcaatccctatcctagctccgaaggctccaggcaaaccagaaagaataggagaaggagatggggaggcgaacggggtagggataggtccgtgagactggtcaacggattcttagccctcgcctgggacgatctgagaaacctctgcctcttcgaaaacctctgggtcaccgtctactatggcgtccccgtctggagagaggctgccacaaccctcttctgtgcctccgacgctaaggcttacgctgccatggctggcagaagcggcggcacagacgaagagctcctgagggctatcagaatcattaacattctgtatcagtccaacccttacccttccgctagtatgagaatcagaacctggaacagcctggtcaagcatcacatgcacatctccaagaaagccaaaggctggttctataggcatcactttgaggagtccgagctcgtgaatcagattatcgaaaagctcatcaaaaaggaaaaggtctacctatcatgggtaccagcccacaagggaatcggacaaaccaaagagctccagaaacagattatcaaaatccaaaactttagggtctactatagggatagcagagaccctatctggaagggacccaaaagctttgaggaaatctggaacaatatgacatggattgagtgggagagagagattagcaattacacaagccaaatctataagattctgaaacccgaacccacagcccctcccgctgagaatttcagattcggtgaggaaactacaccctcccaaaagcaagagcaaaaggataaggagcaatacgatcagattcttattgagatttgcggcaagaaagctattggtacggtgctcgtgggacctacccctgtgaatatcattggcagaatttacgaaacctatggcgatacctgggagggcgtcgaggctctgatcagaatcctccagcaactgatgtttatccatttcagaatcggatgttttcattgccaagtgtgttttctcaccaaaggtctcggcattagccacggaaggaaaaagagaaaacagagaaggggagctccccaagctgccatggaccccgtggaccccaagctggagccttggaaacaccctggctcccagcctaagacagcctgttacaaatgctattgcaaaaagtgccctagcgaagagacaacccctagccagaaacaggaacagaaagacaaagaactctacccccctttagccagcctcaagtccctgtttggcaatgacaatttcaatatgtggaagaatgacatggtggaacagatgcaagaagacattatcttactatgggaccaaagcctcaagccttgcgtcaagctcgacgtcggcgatgcctatttctccgtgcctctggataaaaacttcagaaagtataccgctttcacaatccctagcacaaacaatgagcaactgaaaggcgaagccatccatggccaagtgaattgctcaccaggcatttggcaactggattgcacacacctggagggaaagattatccctaaggtcaagcaatggcctctgacagaggaaaagattaaggctctgactgagatttgcaaagagatggaggaagagggaaagattagcatggatgacctctacgtcggctccgacctggagattggccaacataggaccaaaatcgaagagctcagggaacacctcctgaaatggggactcaccgaaaccacaaaccaaaagactgagctccaagctatccatctggctctgcaagactccggcttagaggtcaacattgtgacagacattcccgctgagactggtcaagagaccgcctttttcattctgaaactggctggcagatggcctgtgaaagtcattcacacagacaatggcaggacaaagattgaggaactgagaccgcatctgctcaaatggggcttcacaacccctgacaaaaagcatcagaaagagcctccctttctgtctagtgtcaagaaactgacagaggataagtggaacgaaccccagaaaatcaagagacgcagagaaaatcacacaatgaatggccatactgccacagagtcccagaatcagcaagacagaaacgaaaaggaactgctggagctcgacaaatgggcaagcctctggaattggtttaacattaccgacaccggaaatagctccaaagtgtcccagaattaccctatcgtccagaatgtccaaggccaaatggtccaccaacccctctcccccagactcatcggactgagaatcgttttcgctgtgctcagcattatcaatagggtcaggcaaggctatagccctctgtccttccaaaccctccccctcatccatctgcaatactttgactgtttcgctgactccaccattaggagagccatcttgggacacatagtgagaaggagatgcgaatacgctgtgggactcggagccatgttccttggctttctgggtgccgctggctccaccatgggcgctgcctccatgacactgacagtgcaagcctatgaccctagcaaagacctcattgctgagattcagaaacagggccagggtcagtggacatttcagattttccaagagcctttcaaaaacggaaccgtcctggtcggccctacacccgtcaacatcatcggaaggaacatgctgacacagcttggccgcactctcaactttcccattagcaaaggcagccctgctatctttcagtccagcatgccacagattctggagccttttaggataaaaaaccctgagatggtcatctatcagtatcctagccctctgacattcggatggtgtttcaaactggtccccgtggaccccagcgaagtggaagagatcaacaagggcgaaaacaattgccccctgtttaggaaatacacagcctttaccattccctccatcaataacgaaacccctggcattaggtatcagtataacgtcctgcctcagggatggggaagcacaatgggagccgccagcatgaccctcaccgtccaggctaggctactgctcagcggaatcgtccagcaacagagcaatctgctggaggagaatagggaaatcctcagagagcctgtgcatggcgtctactacgatccctccaaggatctggtcgctgaaatccaaaagcaaggcagagaggaactgtccaccatggtggatatgggaaactacgacctcggagtggacaataacctcgccgctattagaatcctgcaacagctcatgttcattcactttaggattggctgccagcactccaggattggcatcatccgtcagagaagggccagagctcccaggaaaaagggatgctggaagtgtggcagagagggacaccagatgaaggattgcactgagagacaggctaactttctgggaaaggatgccagactggttatcaaaacctattggggactgcataccggtgagagagactggcacctcggccatggcgtcagcattgagtggaggataagggaaagggctgaggatagcggcaacgaaagcgaaggcgacacagaagagctcagcacattggtggacatgggcaattacgatctgtctagccctgcccccaggggacccgataggctggagagaatcgaagaggaaggcggagagcaaggcagaggcagaagcgtcaggctcgtgaatggcagagaggtcgaggaagtcaatgagggagagaataactgtctgcttcaccctatcagtcaacatggcatggaagacgaagagagagaggtcaatagcgatatcaaagtggtccccagaaggaaagccaaaatcattagggattacggaaagcaaatggctggcgatgactgtgtggccagcttctcttccgagcaaacaggggctaactcctctacaagcagaaagctgggagacggaggcggagccgacagacagggaacaagctccagctgtttcaattgcggcaaagagggacacattgccaaaaactgtagggcccctcgcaagaaaggttgttggaaatgcggaaaggaaggccatcaaatgaaagactgtaccgaaaggcaagccaatttcctcggcaaaatctggccctccaacaaaggcagacccggaaactttctccaaagcaaatggctctggtatatcaaaatctttatcatgatcgtcggtggactgattggcctcaggattatctttgccgtcctgtccatcgttaacggagccgtgagccgagacctcgataaacatggcgctattacaagctccaataccgctgccaataacgctgactgtgtctggctgaaggctgctgccatgacacccctggagatcatcgctatcgtcgcctttatcgtcgccctcatcatagccattgtggtctggacaatcgtctacattgagtatgtcgactgaagatctgaattc

SEQ ID NO: 393 - protein, 1896 aa, Artificial
  HIV cassette A1
GSTMTGPCTNVSTVQCTHGIRPVVSTQLLLNGSLRSLYNTVATLWCVHQRIDVRDTKEALDKIELGDGGGAERQGTSSSFNFPQITLWQRPLVTEPFRKKNPDMVIYQYMDDLYVGSDLEIGQHFTTPDKKHQKEPPFLWMGYELHPDRWTVQPLNFPQITLWQRPLVTIKIGGQLIEALLDTGSYGRKKRRQRRRAPQSSKDHQYPISEQPLSFFRENLAFQQGKAREFSSEQTRANSSASRKSPQISGESSVILGSGTKNAATRRIEVKDTKEALDKIEEVQKKSEQKTQQAAAKAGYVTDRGRQKIISLTETTNQKTELHAIQEATTTLFCASDAKAYETEVHNVWATHACVPADDTVLEEMNLPGKWKPKMIGGIGGFIKVRKIGPENPYNTPIFAIKKKDSTKWRKLVDFRVRIINILYQSNPYPSSEGSRQTRKNRRRRWGGERGRDRSVRLVNGFLALAWDDLRNLCLFENLWVTVYYGVPVWREAATTLFCASDAKAYAAMAGRSGGTDEELLRAIRIINILYQSNPYPSASMRIRTWNSLVKHHMHISKKAKGWFYRHHFEESELVNQIIEKLIKKEKVYLSWVPAHKGIGQTKELQKQIIKIQNFRVYYRDSRDPIWKGPKSFEEIWNNMTWIEWEREISNYTSQIYKILKPEPTAPPAENFRFGEETTPSQKQEQKDKEQYDQILIEICGKKAIGTVLVGPTPVNIIGRIYETYGDTWEGVEALIRILQQLMFIHFRIGCFHCQVCFLTKGLGISHGRKKRKQRRGAPQAAMDPVDPKLEPWKHPGSQPKTACYKCYCKKCPSEETTPSQKQEQKDKELYPPLASLKSLFGNDNFNMWKNDMVEQMQEDIILLWDQSLKPCVKLDVGDAYFSVPLDKNFRKYTAFTIPSTNNEQLKGEAIHGQVNCSPGIWQLDCTHLEGKIIPKVKQWPLTEEKIKALTEICKEMEEEGKISMDDLYVGSDLEIGQHRTKIEELREHLLKWGLTETTNQKTELQAIHLALQDSGLEVNIVTDIPAETGQETAFFILKLAGRWPVKVIHTDNGRTKIEELRPHLLKWGFTTPDKKHQKEPPFLSSVKKLTEDKWNEPQKIKRRRENHTMNGHTATESQNQQDRNEKELLELDKWASLWNWFNITDTGNSSKVSQNYPIVQNVQGQMVHQPLSPRLIGLRIVFAVLSIINRVRQGYSPLSFQTLPLIHLQYFDCFADSTIRRAILGHIVRRRCEYAVGLGAMFLGFLGAAGSTMGAASMTLTVQAYDPSKDLIAEIQKQGQGQWTFQIFQEPFKNGTVLVGPTPVNIIGRNMLTQLGRTLNFPISKGSPAIFQSSMPQILEPFRIKNPEMVIYQYPSPLTFGWCFKLVPVDPSEVEEINKGENNCPLFRKYTAFTIPSINNETPGIRYQYNVLPQGWGSTMGAASMTLTVQARLLLSGIVQQQSNLLEENREILREPVHGVYYDPSKDLVAEIQKQGREELSTMVDMGNYDLGVDNNLAAIRILQQLMFIHFRIGCQHSRIGIIRQRRARAPRKKGCWKCGREGHQMKDCTERQANFLGKDARLVIKTYWGLHTGERDWHLGHGVSIEWRIRERAEDSGNESEGDTEELSTLVDMGNYDLSSPAPRGPDRLERIEEEGGEQGRGRSVRLVNGREVEEVNEGENNCLLHPISQHGMEDEEREVNSDIKVVPRRKAKIIRDYGKQMAGDDCVASFSSEQTGANSSTSRKLGDGGGADRQGTSSSCFNCGKEGHIAKNCRAPRKKGCWKCGKEGHQMKDCTERQANFLGKIWPSNKGRPGNFLQSKWLWYIKIFIMIVGGLIGLRIIFAVLSIVNGAVSRDLDKHGAITSSNTAANNADCVWLKAAAMTPLEIIAIVAFIVALIIAIVVWTIVYIEYVD

SEQ ID NO: 394 - DNA, 5685 bp, Artificial
  HIV cassette B1
  CDS (10)..(5670)
ggatccaccatgctcgagaatatgctcacccaaatcggatgcacactgaatttccctatctcccccattgagacagtgcctgtgaaactgaaacccggaatggatggcgccgccacctttaggcctggcggaggcaatatcaaagacaattggagaagcgaactgtataagtataaggtcgtgaagattaagcctctgggaatcacatggattcccgaatgggagttcgtcaacacacccccactggtcaagctatggtatcagctggagaaagaccctatcgttggcgttgagcctcaggatctcaacacgatgctgaatcttgtaggaggccatcaggccgctatgcaaatgctgaaagagacaatcaatgaggaagcctctgtcctgtttctggatggcattgacaaagctcaagaggaacatgaaaagtatcactccaactggaggacaatggccaacgactttaatctgatgaagcatctcgtctgggcctctagggagctggagagattcgctctgaatcccagcctgctggagacatccgaaggctgtcagcaaattgctgaggaagagattatcattaggtccgagaatttcacaaacaatgtcaaaaccattatcgtccaactcaacgaaagcgtcgagattaacatgggcgctagggctagtgtcctcagaggcggcaagctggacgcctgggaaaagattaggctcaggcctggcggaaagaaaaagtataggctcaaggagaagggaggcctggagggactggtttactccaaaaagaggcaagacattctggatctgtgggtgtataacacacagggattcactagatggggaaccatgatcctcggcttggtgattatctgtagcgccagcgagaatctgtgggtgacagtgtattacggagtgcctgtgtggaggagacagctcctgtccggcattgtgcaacaacaaaataacctcctgagggctatcgaagcccaacagcatctgctccagctcaccgtctgggtcaggcatttccccaggccttggctccacggcctgggacagtacatctatgagacatacggagacacatgggcgggagtggaagccctcacagccctcatcacacccaaaaagattaggcctcccctcccatccgtgaaaaagctcaccgaagacagatggaatgagcctcaaaagacatatagcgctggcgaaaggattatcgatatcattgcatccgacattcagactaaggaactgcaaaagcaaatcctaaagattcagaatttcgctgtgtttatccataactttaagaggaagggaggcattggcggctactccgccggagagagaatcattgacattatcgccaccgatatcattcccgtgggcgaaatctataagagatggatcattctgggactcaacaaaatcgtgagaatgtatctacccgtcagcattctggatatcagagtgagacagggatactcccccctcagctttcagacactgctgcccgctcccagaggccctgacagactcggaggcattgaggaagagtccagccaggaccatcagtatcccattcccgaacagcctctgcctcagacaaggggagacaatcccacagaccctaaggaaagcaaaaaggctagtggaggggtcgagtccatgaataaggaactgaaaaagattatcggacaggtcagggaccaggctgagcacctgaaaaccgctgtgcaaatggctgccatgcagatgctcaaggataccattaacgaagaggctgccgagtgggacagagtccatcccgtccatgccgggcccgttccccctctcaccgagatttgtaaagaaatggaaaaagaaggcaaaatctccaagattggccctgagaatccctataacacacccatctttgccattcaagtgagagagcaagccgaacacctcaagacagccgtccagatggcagtcttcattcacaatttcaaaaggagaggcggaatcggaggcaaaaagaaagatagcacaaagtggaggaaactggtagactttagggagctcaacaaacgtacacaggatttctgggaggtccagctcggctttttggctctggcttgggatgacctcaggagcctgtgtctgttcagctatcacagactgagagactttatcctcatcgttgccagaatctgccgacatagcagaatcggcatcactaggcaacgtagaggtaggaacggcgcctccagttccgctgcccccaaaatctccttcgaccccattcccattcactattgcgctcccgctggcttcgctatcctcaagtgtaacgataagaacttcaatggcgaagaggattggcatctgggacagggagtgtccatcgaatggagacagaaaagctatagcacacaggtggaccctgacctcgccgatcagcctagcctctatcctcccttagcttccctgaaaagcctcttcggaaacgatcccttatcccaagccgctagaagggctatcctcggccatatagtcaggagaaggtgtgagtatcagtccggacacaataaggtcggctccctgcaatacctcgcactcagtcaacccacaaccgcttgctacaagtgttactgtaagaaatgttgcttccactgtcaggtctgcttcctgaagaagggactgggaatcagggattacggaaagcaaatggctggcgatgactgtgtggccagcaggcaagacgaagacgcagccaagtaccatagcaattggagaaccattggcaatgagtttaacctcccccctatcgtccctaaggaaatcgtcgcaaattgcaataagtgtaacgaatggacactggaactgctggaggaactgaaacatgaagccgtgagacactttcccagaccctggctgcatggcctcggtcaacacgatatcattagcctctgggatcagtccctgaaaccctgtgtgaaactgacacccctctgcgtcaccctcaactgtaccaatgccaatctgatgaagagatactccacccaagtggaccccgatctggctgaccaactgattcacctccactatttcgattgctttgccgatagcgcaatccatcccatcggccaacacggaatggaggatgaggatagggaagtgctgaaatggaaattcgatagccatctggctctcaggcatatcgcttctagtcctatcgataccgtccccgtcaagctcaagcctggcatggacggacccaaagtgaaacactggcccctcaccgaagagaaaatcaaagccatttggcctagcaacaagggaaggcctggcaatttcccgcagtccaggcctgagcctaccgcacccccagccgagagctttagattcggcattagcaaaaaggctaagggatggttttacagacaccattacgatagccgacaccctaaggtcagctccgaggtccacattcccctcggcatgatgaccgcttgccaaggcgtcggcggacccagtcacaaagccagggtactggcagaggctatatcccaggtgaacaacgctaacattcctcccattgtggccaaagagattgtggcaaactgtgacaaatgccagctcaagagtgaggctattcacggacaggtgaactgtagcccttccgagggaacaagacagactaggaagaacagacgtagaaggtggcgtgcgaggcaaaggcaaatccactccatctccgagaggattctgggacagatgagggaacccagaggctccgacattgccggtactacaagcacactgcaagagcaaatcgcatggatgacaagcaatccccctagcattcaacaagagtttggcattccctataaccctcagtcccagggcgtcgtggaaagcatgaacaaagagctaaagaaaatcattggcagacaggagatcctcgatctctgggtctaccatacccaaggctatttccctgactggcagaattacacacccggacccggagtcagataccctagcagagaaagacagagacagattcattctattaacgaatggattctcagcaactgcctcggcagatccgctgagcctgtgcctctgcaactgtataagacactgagagccgaacaggctacccaagaggtcaagaattggatgaccgagacactgctcgtgcaaaacgctaaccctgactgtgagagagtgtatctggcttgggtccccgctcataaaggcattggcggaaacgaacaggtggacaaactggtcagcgctggcattaggaaaacagaccctaaccctcaggaaatccatctggaaaacgtcaccgagaactttaacatgtggaaaaacgatatggtggagcaaatgcatgaggctggctatgccattctgaaatgcaataacaaaaggttcaacggaactggacccagtaagaatgtgtccaccgtccagtgtacccatggcctagagctcaagaatagcgctatctccctgctcaacgctaccgctatcgctgtggctgggtggaccgatagggttatcgaagtggttcagtcccggcatcccaaagtgtccagcgaagtgcatatccctctgggagacgctaggctcatcattaggacatactggggcctccacacaggcgctgctatgggcggtaaatggtccaagtgctccctcgtcggatggcccgcagtgagagagagaatcagacagacaccccctgccgctgagggagtgctcaagaccggcaagtactctaggaagaggggtgcccataccaatgacgtcaagcaactgacagaggctgtgcaaaagattgccacagagtctagctgggagggtctgaaatactgggggaatctgctccagtactggggccaggaactgaaaatctccgccgtcagcctcctgaatgccacagccattgagctgcctgagaaagaaagctggaccgtcaacgatatccaaaagctcgtgggaaagctcaactgggcatcccagatttaccccggaagagccattgaggctcagcaacacatgctgcaactgacagtgtggggcattaagcaactgcaagccagagtgctcgccattgagagatacctcgccctccaggatagcggattggaagtgaatatcgtcaccgatagccaatacgctctaggcatcattcaggctcagcctgacaaaagcgaaagggaaatctccaactataccaatcagatttacaagatcctcaccgaatctcaaaatcaacaggataggaatgagaaagacctcctggctcccacaaaggctaagagaagggtcgtgcaaagggaaaagcgtgccgtcggcattggcgctatgtttctcggattcctcggcgctgccaaacccaaaatgatcggaggcattggaggctttatcaaagtcaggcagtatgaccaaatccttatcgaaatctgtggaaacaaggctatctcctaccataggctcagggatttcattctgatcgtcgctaggattgtggaactgctcggccgtagctccctgaaaggcctccagagaggcacactgaatgcctgggtgaaagtgattgaggaaaagggattcagtcccgaagtgattcccatgttttccgctctgtccgagggagccacactcgagtgaagatctgaattc

SEQ ID NO: 395 - protein, 1887 aa, Artificial
  HIV cassette B1
MLENMLTQIGCTLNFPISPIETVPVKLKPGMDGAATFRPGGGNIKDNWRSELYKYKVVKIKPLGITWIPEWEFVNTPPLVKLWYQLEKDPIVGVEPQDLNTMLNLVGGHQAAMQMLKETINEEASVLFLDGIDKAQEEHEKYHSNWRTMANDFNLMKHLVWASRELERFALNPSLLETSEGCQQIAEEEIIIRSENFTNNVKTIIVQLNESVEINMGARASVLRGGKLDAWEKIRLRPGGKKKYRLKEKGGLEGLVYSKKRQDILDLWVYNTQGFTRWGTMILGLVIICSASENLWVTVYYGVPVWRRQLLSGIVQQQNNLLRAIEAQQHLLQLTVWVRHFPRPWLHGLGQYIYETYGDTWAGVEALTALITPKKIRPPLPSVKKLTEDRWNEPQKTYSAGERIIDIIASDIQTKELQKQILKIQNFAVFIHNFKRKGGIGGYSAGERIIDIIATDIIPVGEIYKRWIILGLNKIVRMYLPVSILDIRVRQGYSPLSFQTLLPAPRGPDRLGGIEEESSQDHQYPIPEQPLPQTRGDNPTDPKESKKASGGVESMNKELKKIIGQVRDQAEHLKTAVQMAAMQMLKDTINEEAAEWDRVHPVHAGPVPPLTEICKEMEKEGKISKIGPENPYNTPIFAIQVREQAEHLKTAVQMAVFIHNFKRRGGIGGKKKDSTKWRKLVDFRELNKRTQDFWEVQLGFLALAWDDLRSLCLFSYHRLRDFILIVARICRHSRIGITRQRRGRNGASSSAAPKISFDPIPIHYCAPAGFAILKCNDKNFNGEEDWHLGQGVSIEWRQKSYSTQVDPDLADQPSLYPPLASLKSLFGNDPLSQAARRAILGHIVRRRCEYQSGHNKVGSLQYLALSQPTTACYKCYCKKCCFHCQVCFLKKGLGIRDYGKQMAGDDCVASRQDEDAAKYHSNWRTIGNEFNLPPIVPKEIVANCNKCNEWTLELLEELKHEAVRHFPRPWLHGLGQHDIISLWDQSLKPCVKLTPLCVTLNCTNANLMKRYSTQVDPDLADQLIHLHYFDCFADSAIHPIGQHGMEDEDREVLKWKFDSHLALRHIASSPIDTVPVKLKPGMDGPKVKHWPLTEEKIKAIWPSNKGRPGNFPQSRPEPTAPPAESFRFGISKKAKGWFYRHHYDSRHPKVSSEVHIPLGMMTACQGVGGPSHKARVLAEAISQVNNANIPPIVAKEIVANCDKCQLKSEAIHGQVNCSPSEGTRQTRKNRRRRWRARQRQIHSISERILGQMREPRGSDIAGTTSTLQEQIAWMTSNPPSIQQEFGIPYNPQSQGVVESMNKELKKIIGRQEILDLWVYHTQGYFPDWQNYTPGPGVRYPSRERQRQIHSINEWILSNCLGRSAEPVPLQLYKTLRAEQATQEVKNWMTETLLVQNANPDCERVYLAWVPAHKGIGGNEQVDKLVSAGIRKTDPNPQEIHLENVTENFNMWKNDMVEQMHEAGYAILKCNNKRFNGTGPSKNVSTVQCTHGLELKNSAISLLNATAIAVAGWTDRVIEVVQSRHPKVSSEVHIPLGDARLIIRTYWGLHTGAAMGGKWSKCSLVGWPAVRERIRQTPPAAEGVLKTGKYSRKRGAHTNDVKQLTEAVQKIATESSWEGLKYWGNLLQYWGQELKISAVSLLNATAIELPEKESWTVNDIQKLVGKLNWASQIYPGRAIEAQQHMLQLTVWGIKQLQARVLAIERYLALQDSGLEVNIVTDSQYALGIIQAQPDKSEREISNYTNQIYKILTESQNQQDRNEKDLLAPTKAKRRVVQREKRAVGIGAMFLGFLGAAKPKMIGGIGGFIKVRQYDQILIEICGNKAISYHRLRDFILIVARIVELLGRSSLKGLQRGTLNAWVKVIEEKGFSPEVIPMFSALSEGATLE

SEQ ID NO: 396 - DNA, 5925 bp, Artificial
  HIV cassette C1
  CDS (10)..(5910)
ggatccaccatgctcgagagcaacacacccgctaataatgccgattgcgcgtggctgaaagcccaggaagaggaagaagtgggatttcctgtgagaccccaagtgcctagagcttggagggctatcctcaacattcccaggaggattaggcaaggctttgagagagccctcctagccgccgaatgggacagggttcaccctgtgcacgctggccctgtcgctcccggccaaatgagagagcccagaggaagcgatatcgctggcacaaccctcaggcccatgacatataaggccgctattgacctcagcttgtttctgaaagagaaaggcggactggaaggcctcatctatagcaagaaagctgctatggaacaggctcccgaagaccaaagccctcagagagagccttacaatgagtggaccctggagctcctggaagagctcaagaaagaggctcaaggccaatggacctaccaaatctttcaggaaccctttaagaatctgaaaaccggaaagtattccagaatgagaagcgctcacacaaactggatgacagaaaccctcctggtccagaatgccaatcccgattgcaagtccatcctcagggctctgggaaccggagccacactggaagagcctgaggtcatccctatgttctcagccctcagcgaaggcgctaccccccaagacctgaatacgatgctcaacatcgtcagcggacaccaatccaccctccaggaacagattggctggatgacaaataaccctcccatccctgtcggagagatttacaaaaggtggattatcctcggcctgactagaatcccccatcccgccggcctcaagaaaaagaaaagcgtcaccgtcctggatgtgggagacgcttacttcagcgtccccctcgacgaagaccaaaaggaaacctgggaggcttggtggacggaatactggcaggctacctggattcctgagtgggagtttgtgaatacccctcccctcgtgtttcccgattggcataactatacccctggccctggcataaggtatcccctcacctttggatggtgctttaagctcgtgcctgtggaccccaaactgtggtaccaactggaaaaggaacccattgtcggagccgaaaccttttacgtggacggagccgccaacagagagacaaagctcggccaaaacgtccagggacagatggtgcatcaggctattagccccaggaccctcaacgcttgggtcaaggtcgtcgaagagaaagcctttaacgaaaccgaagtgcataacgtctgggctacccatgcctgtgtgcgtaccgatcccaatccccaagagattctcctggagaatgtgacagagctcaaggatcagaaactcctcggcatttggggatgctccggcaaaatcatttgcacaaccactgtgccttggaacagctcctggtccaaccaagctggccataacaaagtgggaagcctccagtatctggctctgacggctctgattaagcctaagaaaatcaaaccccctctgcctagcgttaagacaatcattgtgcatctgaatgagtccgtggaaatcaattgcacaaggcctaacaataacacaaggaaagccgccgctagtgaagtacggaataagtccaaacagaaaacccagcaagctgccgccgatacaggcgactccagccaggtcagccaaaactatcccattgtgtccaactttacctccaccactgtgaaagccgcttgttggtgggccaatatcaaacaggagtttggaatcccttacaatccccaaagccaaacattctatgtggatggcgctgccaatagggaaacccaactgggaaaggcgggctatgtgacagacaaaggcagacagaaagtcattagcggaatctggcagctcgactgtacccatctggaaggcaaagtcattctggtagccgtccacgtcgcctccggctacattgaggctgaggtcggcaatgagcaagtggataagctcgtgagttccggaatcagaaaggtgctattcctcgacggaatcaataaggctcaggaagagcacgaagtcagggaaaggattaggcgaaccgctcccgctgctgaaggcgtcggcgctgtctcccaggatctggataagtacggagccctcacctccacaagcggaacccaacagtcccagggaactgaaactggcgtcggcaaccctcagattttgggagagtccagcgttgtcctcggctccggctccatcgtcatctggggtaaaacccctaagtttaagttccccattcagaaagagacatgggaagcctggtggacggagtattggcaagccgctgcttacagactgatcagctgtaacacaagcgttatcaaacaggcttgccctaagattacctttgaccctatccctatccattactgtgcccctcctagctggatgggctatgagctccaccctgacagatggacagtgcaacccatcgtgctccccgaaaaggactcctggacagtgaatgacattcagaaatcaattctgagagccctcggcccaggcgcttccctggaggaaatgatgacagcatgtcagggagtgggaggccctggccataaggctagagtgtattacagagactccagggaccccatttggaaaggccctgccaaactgctctggaaaggcgaaggcgctgtggtcatccaagacattaagattggaggccaactgatagaagccctcctggatacaggagccgatgacaccgtcctggaagatatgaatctgcctggcaagtggggaatcaaacagctccaggctagggtcctggctatcgagaggtatctgaaagatcaacagtttctgggactctggggctgtagcggaaaggctgctatggaaaacagatggcaagtgatgatcgtctggcaagtggacaggatgaagattaggacatggaatagcctcgtgaaacaccatatgtatattatctgtaccacaaccgtcccctggaactccacctggagcaataagtccttcgaagagatttggaataacatgacctggattcaatggctgattctcgctatcgtcgtgtggaccattgtgtatatcgaatacaagaaactgctcaggcaaaggagaatcgataggctcatcaaaaggctcaaccctggcctcctggaaaccgctgagggatgtaaacagatcctggaacagctccagcccgccctccagacaggcaccgaagagctctctagtagaaagctcctgaaacagagaaagattgacagactgattgagagaatcagagagagagccgaagactccggcaatgagtccgagggagacacacccggaatcagataccaatacaatgtgctcccccaaggctggaagggctccccacccattttccaaagctccatgacccaaatcctcatgatgcaaaggggaaactttaagggacagaaaaggattatcaagtgcttcaactgtggaaaggaaggccatctcgctaggaattgcagacctcccctagagagactgaacctggattgctccgaggatagcgacacctccggcacacagcaaagccaaggcacagagacagaagtgggactcgtggctgtgcatgtggccagcggatatatcgaagccgaagtgatccctgccgaaactggacaggaaaccgcttactttatcctcaagattaagcctgtggtcagcacacagctcctgctcaacggtagcctcgctgaagaggaaatcattatcagaagcgaaaactttaccgataacaaactggtcggcaaactgaattgggcttcccaaatctacgctggcatcaaagtgaagcaactgtgtaagctcctgagaggcaccaaagccctcactcctctgtgtgtgacactgaattgcacaaacgctaacctcatcaatgtgaatgctgctcaaaccagaggcgataaccctaccggtcccgaagagtccaagaaagaggtcgcgtccaagacagagacagacccttgtgacgccgcccctagctccaactttctgggaaggtctgccgaacccgtccccctccagcccccccctctggaaaggctccacctcgactgtagcgaagactgtggcgaactggataagtgggcctccctgtggaactggttcaatatcaccaactggctgtggtacattaagattttcattatgattgtgggaggcaataagattgtcaggatgtactcacctgtctccatcctcgacattaagcaaggccctaaggaacccttcagggattacgtggacagattcgctaagctcctgtggaagggagagggagccgtcgtgattcaggacaactccgacattaaggtcgtgcccaggagaaaggctaagattatcgaactgaataagagaacccaagacttttgtgaagtgcaactgggaatccctcaccctgctggactgaagaagaaaaagtcagtgacagtggccgctatgagagtgaaagagacacagatgaactggcccaatctgtggaagtggggcacaatgattctgggactggtcatcatttgctccgcctccattaaggtcagacagctctgcaaactgctcaggggtacaaaggctctgacagagattgtgacactgacagaggaagccgaactggaactgctcatatggaagtttgactcccgcctcgccctgagacatatcgccagggaactgcatcccgagttctacaaagactgcgctgctgtcgagctcctgggacgctccagcctcaagggactgcaaaggggatgggaaggcctcaagtatttgtggaacctcctgcagtattggggctctagcctggggcaactgcaacctgctctgaaaaccggatcagaggaactgaagtccctgtataacacaatcgctaccctctggtgtgtgcatcaggagctctacaaatacaaagtggtcaaaatcaaacccctcggcattgcccctaccagagccaaaaggagagtggtcgagagagagaaaaggctcaccgaaatcgtcccactcaccgaagaggctgagctggagctggaggaaaacagagagattctgagggaacccgtccacggagtgtatagagtgctcgccgaagccatgagccaagtcaacaatgccaacatcatgatgcagagaggcaatttcaaaggcctaaagagaatcatcaaacaagaggaagaggaggtcggcttccccgtcaggccccaggtcccactgagacctatgacctacaaaggagccgtcgatctgtccttcttcagacagggacccaaagagcctttcagagactatgtggataggtttttcaaaaccctcagggctgagcaagcctcacaggaagtgaaaaactgggagaaaatcagactgagacctggtggcaaaaagaaatacaaaatgaaacacattgtgtgggcctccagggaactggaaaggtttgcctcccagtatgccctcggcatcatcctagcccaacccgataagtccgagtccgagctcgtgaatcagattatcgaagagctcatcaagaagattgccgtcgccggatggacagacagaatcattgaggtcgaccaaagggcttggagagccattctgaatatccccaggagaatcagacagactagactcgccggaaggtggcccgtcaggacaatctataccgataacggaagcaatttcacaagcgctaccgtcaaggctgcctgctggtgggctgatgtgaaacagctcaccgcagtcgtccagaaaatcgctaccgaaagcattgtgatatggggaaagacgcccaagttcagactgcctatcgctgccgccagcaacgagaacatggagaccatggctgcttgaagatctgaattc

SEQ ID NO: 397 - protein, 1967 aa, Artificial
  HIV cassette C1
MLESNTPANNADCAWLKAQEEEEVGFPVRPQVPRAWRAILNIPRRIRQGFERALLAAEWDRVHPVHAGPVAPGQMREPRGSDIAGTTLRPMTYKAAIDLSLFLKEKGGLEGLIYSKKAAMEQAPEDQSPQREPYNEWTLELLEELKKEAQGQWTYQIFQEPFKNLKTGKYSRMRSAHTNWMTETLLVQNANPDCKSILRALGTGATLEEPEVIPMFSALSEGATPQDLNTMLNIVSGHQSTLQEQIGWMTNNPPIPVGEIYKRWIILGLTRIPHPAGLKKKKSVTVLDVGDAYFSVPLDEDQKETWEAWWTEYWQATWIPEWEFVNTPPLVFPDWHNYTPGPGIRYPLTFGWCFKLVPVDPKLWYQLEKEPIVGAETFYVDGAANRETKLGQNVQGQMVHQAISPRTLNAWVKVVEEKAFNETEVHNVWATHACVRTDPNPQEILLENVTELKDQKLLGIWGCSGKIICTTTVPWNSSWSNQAGHNKVGSLQYLALTALIKPKKIKPPLPSVKTIIVHLNESVEINCTRPNNNTRKAAASEVRNKSKQKTQQAAADTGDSSQVSQNYPIVSNFTSTTVKAACWWANIKQEFGIPYNPQSQTFYVDGAANRETQLGKAGYVTDKGRQKVISGIWQLDCTHLEGKVILVAVHVASGYIEAEVGNEQVDKLVSSGIRKVLFLDGINKAQEEHEVRERIRRTAPAAEGVGAVSQDLDKYGALTSTSGTQQSQGTETGVGNPQILGESSVVLGSGSIVIWGKTPKFKFPIQKETWEAWWTEYWQAAAYRLISCNTSVIKQACPKITFDPIPIHYCAPPSWMGYELHPDRWTVQPIVLPEKDSWTVNDIQKSILRALGPGASLEEMMTACQGVGGPGHKARVYYRDSRDPIWKGPAKLLWKGEGAVVIQDIKIGGQLIEALLDTGADDTVLEDMNLPGKWGIKQLQARVLAIERYLKDQQFLGLWGCSGKAAMENRWQVMIVWQVDRMKIRTWNSLVKHHMYIICTTTVPWNSTWSNKSFEEIWNNMTWIQWLILAIVVWTIVYIEYKKLLRQRRIDRLIKRLNPGLLETAEGCKQILEQLQPALQTGTEELSSRKLLKQRKIDRLIERIRERAEDSGNESEGDTPGIRYQYNVLPQGWKGSPPIFQSSMTQILMMQRGNFKGQKRIIKCFNCGKEGHLARNCRPPLERLNLDCSEDSDTSGTQQSQGTETEVGLVAVHVASGYIEAEVIPAETGQETAYFILKIKPVVSTQLLLNGSLAEEEIIIRSENFTDNKLVGKLNWASQIYAGIKVKQLCKLLRGTKALTPLCVTLNCTNANLINVNAAQTRGDNPTGPEESKKEVASKTETDPCDAAPSSNFLGRSAEPVPLQPPPLERLHLDCSEDCGELDKWASLWNWFNITNWLWYIKIFIMIVGGNKIVRMYSPVSILDIKQGPKEPFRDYVDRFAKLLWKGEGAVVIQDNSDIKVVPRRKAKIIELNKRTQDFCEVQLGIPHPAGLKKKKSVTVAAMRVKETQMNWPNLWKWGTMILGLVIICSASIKVRQLCKLLRGTKALTEIVTLTEEAELELLIWKFDSRLALRHIARELHPEFYKDCAAVELLGRSSLKGLQRGWEGLKYLWNLLQYWGSSLGQLQPALKTGSEELKSLYNTIATLWCVHQELYKYKVVKIKPLGIAPTRAKRRVVEREKRLTEIVPLTEEAELELEENREILREPVHGVYRVLAEAMSQVNNANIMMQRGNFKGLKRIIKQEEEEVGFPVRPQVPLRPMTYKGAVDLSFFRQGPKEPFRDYVDRFFKTLRAEQASQEVKNWEKIRLRPGGKKKYKMKHIVWASRELERFASQYALGIILAQPDKSESELVNQIIEELIKKIAVAGWTDRIIEVDQRAWRAILNIPRRIRQTRLAGRWPVRTIYTDNGSNFTSATVKAACWWADVKQLTAVVQKIATESIVIWGKTPKFRLPIAAASNENMETMAA

SEQ ID NO: 398 - DNA, 5703 bp, Artificial
  HIV cassette A2
  CDS (10)..(5688)
ggatccaccatgacaggcccttgcacaaacgtcagctccgtgcaatgcacacacggaatcaaacccgtcgtgtccacccaactgctcctgaatggctccctgaaaagcctctacaataccgtcgccacactgtggtgtgtccaccaaaggattgaggtcaaggacacaaaggaagccctcgacaaaatcgaactcggcgatggcggaggcgctgaaaggcaaggcacctccagctccatcaactttccacaaatcacactgtggcaaaggcctctggtcaccgaacccttcagaaaagagaatcccgaaatggtgatttaccagtacatggacgatctgtatgtgggaagcgatctggaaatcggacagcattttaccacacccgataagaaacaccaaaaggaaccaccattcctctggatgggatacgaactgcatcccgataggtggaccgtccagccttttaatttccctcagattaccctctggcagcgtcccctcgtgacaatcaaaatcggcggacagctcatagaggctctgctcgacacaggctcctatggcagaaagaaacgtaggcaacgtagacgcgctcctcagagcagaaaggatcaccaataccctatctctgagcaacccctctccttctttagggaaaacctggctttccagcaaggtaaagccagagagttttccagcgaacagacaggagccaatagctccgcctccaggaagagcccccaaatctccggcgaaagctccgtcattctgggatctggcaccaaaaacgccgctactagaagaatcgatgtgagagataccaaagaggctctggataagattgaggaggagcaaaacaaaagcaagcaaaagacacaacaggctgccgctaaagccggatacgtcaccgataggggaaggcaaaagattatctccctgacagagacaaccaatcagaaaaccgaactgcatgccattcaagaagccgataccacactgttttgcgccagcgatgccaaagcctatgacacagaggtccacaatgtgtgggccacacacgcttgcgtccccgctgacgatacagtgctggaggagatgaacctccccggaaaatggaagcctaagatgattggcggaatcggcggattcattaaggtgagaaagatcggacccgaaaacccttacaataccccaatcttcgctatcaagaaaaagaactccaccaaatggagaaagctcgtggatttcagaattaggattatcaaaatcctctaccaaagcaatccctatcctagctccgaaggcaccaggcaaaccagaaagaataggagaaggggatggggaggcgaacagggtagggataggtccgtgagactggtcaacggattcttagccctcgcctgggacgatctgagaagcctctgcctcttcgacaacctctgggtcaccgtctactatggcgtccccgtctggagagaggctaacacaaccctcttctgtgcctccgacgctaaggcttacgctgccatggctggcagcagcggcagcacagacgaagagctcctgaaggctgtcagaatcattaagattctgtatcagtccaacccttacccttccgctagtatgaaaatcagaacctggaagagcctggtcaagcatcacatgtacatctccaagaaagccaatggctggttctataggcatcactttgaggagtccgaggtcgtgaatcagattatcgaaaagcttatcaaaaaggaaaaggtctacctatcatgggtaccagcccacaagggaatcggacgaaccaaagagctccagaaacagattatcaaaatccaaaactttagggtctactatagggatagcagagaccctatctggaagggacccaaaagccttgaggaaatctggaacaatatgacatggattcagtgggagagagagattagcaattacacaaacctaatctataagattctgagacccgaacccacagcccctcccgctgagaatttcggattcggtgaggaaactacaccctcccaaaagcaagagccaaaggataaggagcaatacgatcagattattattgagatttgcggcaagaaagctattggtacagtgctcgtgggacctacccctgtgaatatcattggcagaatttacgaaacctatggcgatacctgggagggcgtcgaggctctgatcagaatcctccagcaactgatgtttatccatttcagaatcggatgttttcattgccaagtgtgttttctcaccaaaggtctcggcattagccacggaaggaaaaagagaaaacagagaaggcgagctccccaagctgccatggaccccgtggaccccaacctggagccttggaaacaccctggctcccagcctaagacagcctgtaacaaatgctattgcaaaaagtgccctagcgaagagacaacccctagccagaaacaggaacagaaagacaaagaactctacccccctttagccagcctcaagtccctgtttggcaatgacaatttcaatatgtggaagaataacatggtggaacagatgcaagaagacattatctcactatgggaccaaagcctcaagccttgcgtcaagctcgacgtcggcgatgcctatttctccgtgcctctggataaaaacttcagaaagtataccgctttcacaatccctagcacaaacaatgagcaactgaaaggcgaagccatgcatggccaagtgaattgctcaccaggcatttggcaactggattgcacacacctggagggaaagattatccctaaggtcaagcaatggcctcagacagaggaaaagattaaggctctgactgagatttgcacagagatggagcaagagggaaagattagcatggatgacctctacgtcggctccgacctggagattggccaacataggaccaaaatcgaagagctcagggcacacctcctgagatggggactcaccgacaccacaaaccaaaagactgagctccacgctatccatctggctctgcaagactccggcttagaggtcaacattgtgacagacattcccgctgagactggtcaagagaccacctatttcattctgaaactggctggcagatggcctgtgagaatcattcacacagacaatggcaggacaaagattgaggaactgagaccgcatctgctcaaatggggcttcacaacccctgacaaaaagcgtcagaaagagcctccctttctgtctagtgtcaagaaactgacagaggataagtggaacaaaccccagaaaatcaagggacacagagaaaatcacacaatgaatggccatgctgccacagagtcccagaatcagcaagacagaaacgaaaaggaactgctggagctcgacaaatgggcaagcctctggaattggtttaacattaccgacaccggaagtagctcccaagtgtcccagaattaccctatcgtccagaatctccaaggccaaatggtccaccaacccatctcccccagactcgtcggactgagaatcattttcgctgtgctcagcattatcaatagggtcaggcaaggctatagccctctgtccttccaaaccctcaccctcatccatctgtattactttgactgtttcgctgactccaccattaggagagccatccttggacacagagtgagcaggagatgcgaatacgctgtgggaatcggagccatgttccttggctttctgggtgccgctggctccaccatgggcgctgcctccatcacactgacagtgcaagcctatgaccctagcaaagacctcattgctgagattcagaaacagggtcaggatcagtggacatatcagattttccaagagcctttcaaaaacggaaccgtcctggtcggccctacacccgtcaacatcatcggaaggaacctgctgacacagataggctgcaccctcaactttcccattagcaaaggcagccctgctatctttcagtccagcatgacacagattctggagccttttaggaaacaaaaccctgacatggtcatctatcagtatcctagccctctgacattcggatggtgtttcaaactggtccccgtggaccccagcgaagtggaagagaccaacaagggcgaaaacaattgcctcctgtttaggaaatacacagcctttaccattccctccaccaataacgaaacccctggcattaggtatcagtataacgtcctgcctcagggatggggaagcacaatgggagccgccagcatgaccctcaccgtccaggctaggcaactgctcagcggaatcgtccagcaacagaacaatctgctggaggagaatagggaaatcctcaaagagcctgtgcatggcgtctactacgatccctccaaggatctgatcgctgaaatccaaaagcaaggcacagaggaactgtccgccttggtggatatgggaaactaccacctcggagtggacaataacctcgccgctattagaatcctgcaacagctcatgttcattcactttaggattggctgccagcactccaggattggcatcatccgtcagagaagggccagagctcccaggaaaaagggatgctggaagtgtggcaaagagggacaccagatgaaggattgcactgagagacaggctaactttctgggaaaggatgccagactggttatcaaaacctattggggactgcataccggtgagagagactggcacctcggccatggcgtcagcattgagtggaggacaagggaaagggctgaggatagcggcaacgaaagcgaaggcgacagagaagagctcagcacaatggtggacatgggcaattacgatctgtctagccctgcccccaggggacccgataggctggagagaatcgaagaggaaggcggagagcaagacagagacagaagcgtcaggctcgtgaatggcagtgagggcgaggaagtcaataagggagagaataactgtctgctccaccctatgagtcaacatggcatggaagacgaagacagagaggtcaatagcgatatcaaagtggtccccagaaggaaagccaaaatcattagggattacggaaagcaaatggctgacgatgactgtgtggccggcttctcttccgagcaaacaagggctaactcccctgcaagcagaaagctgggagacggaggcggagccgacagacagggaacaagctccagctgtttcaattgcggcaaagagggacacattgccaaaagctgtagggcccctcgcaagaaaggttgttggaaatgcggaagggaaggccatcaaatgaaagactgtaccgaaaggcaagccaatttcctcggcaaaatctggccctccaaaaaaggcagacccggaaactttctccaaagcaaatggctctggtatatcaaaatctttatcatgatcgtcggtggactgattggcctcaggattatctttgccgtcctgtccatcattaacggggccgtgagccgagacctcgataaacatggcgctattacaagctccaataccgctgccaataaccctgactgtgtctggctggaggctgctgccatgacacccctggagatcatcgctatcgtcgcccttatcgtcgccctcatcatagccattgtggtctggacaatcgtctacattgagtatgtcgactgaagatctgaattc

SEQ ID NO: 399 - protein, 1893 aa, Artificial
  HIV cassette A2
MTGPCTNVSSVQCTHGIKPVVSTQLLLNGSLKSLYNTVATLWCVHQRIEVKDTKEALDKIELGDGGGAERQGTSSSINFPQITLWQRPLVTEPFRKENPEMVIYQYMDDLYVGSDLEIGQHFTTPDKKHQKEPPFLWMGYELHPDRWTVQPFNFPQITLWQRPLVTIKIGGQLIEALLDTGSYGRKKRRQRRRAPQSRKDHQYPISEQPLSFFRENLAFQQGKAREFSSEQTGANSSASRKSPQISGESSVILGSGTKNAATRRIDVRDTKEALDKIEEEQNKSKQKTQQAAAKAGYVTDRGRQKIISLTETTNQKTELHAIQEADTTLFCASDAKAYDTEVHNVWATHACVPADDTVLEEMNLPGKWKPKMIGGIGGFIKVRKIGPENPYNTPIFAIKKKNSTKWRKLVDFRIRIIKILYQSNPYPSSEGTRQTRKNRRRGWGGEQGRDRSVRLVNGFLALAWDDLRSLCLFDNLWVTVYYGVPVWREANTTLFCASDAKAYAAMAGSSGSTDEELLKAVRIIKILYQSNPYPSASMKIRTWKSLVKHHMYISKKANGWFYRHHFEESEVVNQIIEKLIKKEKVYLSWVPAHKGIGRTKELQKQIIKIQNFRVYYRDSRDPIWKGPKSLEEIWNNMTWIQWEREISNYTNLIYKILRPEPTAPPAENFGFGEETTPSQKQEPKDKEQYDQIIIEICGKKAIGTVLVGPTPVNIIGRIYETYGDTWEGVEALIRILQQLMFIHFRIGCFHCQVCFLTKGLGISHGRKKRKQRRRAPQAAMDPVDPNLEPWKHPGSQPKTACNKCYCKKCPSEETTPSQKQEQKDKELYPPLASLKSLFGNDNFNMWKNNMVEQMQEDIISLWDQSLKPCVKLDVGDAYFSVPLDKNFRKYTAFTIPSTNNEQLKGEAMHGQVNCSPGIWQLDCTHLEGKIIPKVKQWPQTEEKIKALTEICTEMEQEGKISMDDLYVGSDLEIGQHRTKIEELRAHLLRWGLTDTTNQKTELHAIHLALQDSGLEVNIVTDIPAETGQETTYFILKLAGRWPVRIIHTDNGRTKIEELRPHLLKWGFTTPDKKRQKEPPFLSSVKKLTEDKWNKPQKIKGHRENHTMNGHAATESQNQQDRNEKELLELDKWASLWNWFNITDTGSSSQVSQNYPIVQNLQGQMVHQPISPRLVGLRIIFAVLSIINRVRQGYSPLSFQTLTLIHLYYFDCFADSTIRRAILGHRVSRRCEYAVGIGAMFLGFLGAAGSTMGAASITLTVQAYDPSKDLIAEIQKQGQDQWTYQIFQEPFKNGTVLVGPTPVNIIGRNLLTQIGCTLNFPISKGSPAIFQSSMTQILEPFRKQNPDMVIYQYPSPLTFGWCFKLVPVDPSEVEETNKGENNCLLFRKYTAFTIPSTNNETPGIRYQYNVLPQGWGSTMGAASMTLTVQARQLLSGIVQQQNNLLEENREILKEPVHGVYYDPSKDLIAEIQKQGTEELSALVDMGNYHLGVDNNLAAIRILQQLMFIHFRIGCQHSRIGIIRQRRARAPRKKGCWKCGKEGHQMKDCTERQANFLGKDARLVIKTYWGLHTGERDWHLGHGVSIEWRTRERAEDSGNESEGDREELSTMVDMGNYDLSSPAPRGPDRLERIEEEGGEQDRDRSVRLVNGSEGEEVNKGENNCLLHPMSQHGMEDEDREVNSDIKVVPRRKAKIIRDYGKQMADDDCVAGFSSEQTRANSPASRKLGDGGGADRQGTSSSCFNCGKEGHIAKSCRAPRKKGCWKCGREGHQMKDCTERQANFLGKIWPSKKGRPGNFLQSKWLWYIKIFIMIVGGLIGLRIIFAVLSIINGAVSRDLDKHGAITSSNTAANNPDCVWLEAAAMTPLEIIAIVALIVALIIAIVVWTIVYIEYVD

SEQ ID NO: 400 - DNA, 5685 bp, Artificial
  HIV cassette B2
  CDS (10)..(5670)
ggatccaccatgctcgagaatatgctcacccaaatcggatgcacactgaatttccctatctcccccattgacacagtgcctgtgaaactgaaacccggaatggatggcgccgccatctttaggcctggcggaggcaatatgaaagacaattggagaagcgaactgtataagtataaggtcgtgaagattaagcctctgggaatcacatggattcccgaatgggagttcgtcaacacacccccactggtcaagctatggtatcagctggagaaagagcctatcgttggcgctgagcctcaggatctcaacacgatgccgaatactgtaggaggccatcaggctgctatgcaaatgctgaaagacacaatcaatgaggaagccgctgtcctgtttctggatggcattaacaaagctcaagaggaacatgagaagtatcactccaactggaggacaatggccaacgactttaatctgatgaagcatctcgtctgggcctctagggagctggagagattcgctctgaatcccggcctgctggagacatccgaaggctgtaagcaaattgctgaggaagagattatcattaggtccgagaatttcacaaacaatgtcaaaaccattatcgtccacctcaacgaaagcgtcgagattaacatgggcgctagggcaagtgtcctcagcggcggcaagctggacgcctgggaaaagattaggctcaggcctggcggcaagaaaaagtataggctcaaggagaagggaggcctggacggactgatttactcccaaaagaggcaagacattctggatctgtgggtgtataacacacagggattcactagatggggaaccttgatcctcggcttggtgattatctgtagcgccagcgagaatctgtgggtgacagtgtattacggagtgcctgtgtggaggagacagctcctgtccggcattgtgcaacagcaaaataacctcctgagggctatcgaagcccaacagcatctgctccagctcaccgtctgggtcaggcatttccccaggccttggctccacagcctgggacagtacatctatgagacatacggagacacatggtcgggagtggaagccctcaaagccctcatcaaacccaaaaagattaagcctcccctcccatccgtgaaaaagctcaccgaagacaaatggaataagcctcaaaagacatatagcgctggcgaaaggattgtcgatatcattgcaaccgacattcagactaaggaactgcaaaaccaaatcataaagattcagaatttcgctgtgtttatccataactttaagaggaagggaggcattggcggctactccgccggagagagaatcattgacattatcgccagcgatatcgttcccgtgggcgatatctataagagatggatcattctgggactcaacaaaatcgtgagaatgtattcacccgtcagcattctggatatcagagtgagacagggatactcccccctcagctttcagacactgatgcccgctcccagaggccctgacagactcgaacgcattgaggaagagtccaggcaggaccatcagtatcccatttccgaacagcctctgtctcagacaaggggagacaatcccacagaccctaaggaaagcaaaaaggctagtggagtggtcgagtccatgaataaggaactgaaaaagattatcggacaggtcagggaccaggctgagcacctgaaaaccgctgtgcaaatggctgccatgcagatgctcaaggataccattaacgaagaggctgccgagtgggacagaatccatcccgtccatgccggacccattgcccctctcaccgagatttgtaaagaaatggaaaaagaaggcaaaatctccaggattggccctgagaatccctataacacacccgtctttgccattcaagtgagagaccaagccgaacacctcaagacagccgtccagatggcagtcttcattcacaatttcaaaaggaaaggcggaatcggaggcaaaaagaaagatagcacaaagtggaggaaactggttgactttagggagctcaacaaacgtacacaggatttctgggaggtccagctcggcttttcggctctggcttgggatgacctcaggagcctgtgtctgttcagctatcacagactgagagactttatcctcatcgttgccagaacctgccgacatagcagaatcggcatcactaggcaacgtagaggtaggaacggctcctccaggtccgctgcccccaaaatctccttcgaccccattcccattcactattgcgctcccgctggcttcgctatcctcaagtgtaacaataagacattcaatggcgaaaaggattggcatctgggacagggagtgtccatcgaatggagaaagaaaagctatagcacacaggtggaccctgacctcgccgatcagcctagcctctatcctcccttagcttccctgaaaagcctcttcggaaacgatccctcatcccaagccgctagaagggctatcctcggccaaatagtcaggagaaggtgtgagtatcagtccggacacaataaggtcggctccctgcaataccttgcactcagccaacccaaaaccgcttgctacaagtgttactgtaagaaatgttgctaccactgtcaggtctgcttcctgaagaagggactgggaatcagggattacggaaagcaaatcgctggcgctgactgtgtggccagcaggcaagacgaagacgcagccaagtaccatagcaattggagaaccatggccagtgagtttaacctcccccctatcgtcgctaaggaaatcgtcgcaagttgtgataagtgtaacgaatggacactggaactgctggaggaactgaaacatgaagccgtgagacactttcccagaccctggctgcatggcctcggtcaacacgatatcattagcctctgggatcagtccctgaaaccctgtgtgaaactgacacccctctgcgtcaccctcaactgtaccaatgccaatctgctgaagagctactccacccaagtggaccccgatctggctgaccatctgattcacctccactatttcgattgcttttccgatagcgcaatccatcccatgggcctacacggaatggaggatgaggaaagggaagtgctgaaatggaaattcgatagccatctggctctcaggcatatcgcttctagtcctatcgataccgtccccgtcaagctcaagcctggcatggacggacccaaagtgaaacagtggcccctcaccgaagagaaaatcaaagccatttggcctagcaacaagggagggcctggcaatttcctgcagtccaggcctgagcctaccgcacccccagccgagaactttagattcggcattagcaaaaaggctaagggatggttttacagacaccattacgaaagccaacaccctaaggtcagctccgaggtccacattcccctcagcatgatgaccgcttgccaaggcgtcggcggacccagtcacaaagccagggtactggcagaggctatgtcccaggtgaacaacgctaacattcctcccattgtgcccaaagagattgtggcaaactgtgacaaatgccagctcaagggtgaggctatgcacggacaggtggactgtagcccttccgagggatcaagacaggctaggaagaacagacgtagaaggtggcgtgagaggcaaaggcaaatccgcgccatctccgagtggattctgggacagataagggaacccagaggctccgacattgccggtaccacaagcacactgcaagagcaaatcgcatggatgacaaacaatccccctggcattaagcaagagtttggcattccctataaccctcagtcccagggcgtcgtggaaagcatgaacaaagagctcaagaaaatcattggcagacaggagatcctcgatctctgggtctacaatacccaaggctttttccctgactggcagaattacacacccggacccggaatcagataccctagcagagcaagacagagacagattcatgctattagcgaaaggattctcagcaacttcctcggcagacccgctgagcctgtgcctctgcaactgtataagacactgagagccgaacaggctacccaagaggtcaagaattggatgaccgacacactgctcgtgcaaaacgcaaaccctgactgtgagaaagtgtatctggcttgggtccccgctcataaaggcattggcggaaacgaacaggtggacaaactggtcagcgctggcattaggaaaacagaccctaaccctcaggaaatcgatctggaaaacgtcaccgagaactttaacatgtggaaaaacaatatggtggagcaaatgcaagaggctggctatgccattctgaaatgcaataacaaaaagttcaacggaactggaccctgtaagaatgtgtccaccgtccagtgtacccatggcctagagctcaagaatagcgctgtctccctgctcaacgctaccgctatcgctgtggctgagtggaccgatagggttatcgaagtggttcagtcccagcatcccaaagtgtccagcgaagtgcatatccctctgggagacgctaggctcgtcattaagacatactggggcctccacacaggcgctgctatgggcggtaaatggtccaagtgctccctcgtcggatggcccgcagtgagagagagaatcagacagacaccccctgccgctgagggagtgctcaagaccggcaagtactccaggatgaggagtgcccataccaatgacgtcaagcaactgacagaggttgtgcaaaagattgccacagagtctagctgggagggtctgaaatacttgtggaatctgctcctgtactggggcctggaactgaaaaactccgccgtcagcctcctgaatgccacagccattgtgctgcctgagaaagaaggctggaccgtcaacgatatccaaaagctcgtgggaaagctcaactgggcatcccagatttacgccggaagagccattgaggctcagcaacacttgctgcaactgacagtgtggggcattaagcaactgcaagccagagtgctcgccattgagagatacctcgccctccaggatagcggatcggaagtgaatatcgtcaccgatagccaatacgctctaggcatcattcaggctcagcctgacaaaagcgaaagggaaatctccaactataccaatcagatttacaagatcctcaccgaatctcaaaatcaacaggataggaatgagcaagaactcctggctcccacaaaggctaagagaagggtcgtgcaaagggaaaagcgtgccgtcggcattggcgctatgtttttcggattcctcggcgctgccaaacccaaaatgatcggaggcattggaggctttatcaaagtcaggcagtatgaccaaatccttatcgaaatctgtggacagaaggctatctcctaccataggctcagggatttcattctgatcgtcgctaggattgtggaactgctcggccatagctccctgagaggcctccggagaggcacactgaatgcctgggtgaaagtggttgaggaaaagggattcaatcccgaagtgattcccatgtttaccgctctgtccgagggagccacactcgagtgaagatctgaattc

SEQ ID NO: 401 - protein, 1887 aa, Artificial
  HIV cassette B2
MLENMLTQIGCTLNFPISPIDTVPVKLKPGMDGAAIFRPGGGNMKDNWRSELYKYKVVKIKPLGITWIPEWEFVNTPPLVKLWYQLEKEPIVGAEPQDLNTMPNTVGGHQAAMQMLKDTINEEAAVLFLDGINKAQEEHEKYHSNWRTMANDFNLMKHLVWASRELERFALNPGLLETSEGCKQIAEEEIIIRSENFTNNVKTIIVHLNESVEINMGARASVLSGGKLDAWEKIRLRPGGKKKYRLKEKGGLDGLIYSQKRQDILDLWVYNTQGFTRWGTLILGLVIICSASENLWVTVYYGVPVWRRQLLSGIVQQQNNLLRAIEAQQHLLQLTVWVRHFPRPWLHSLGQYIYETYGDTWSGVEALKALIKPKKIKPPLPSVKKLTEDKWNKPQKTYSAGERIVDIIATDIQTKELQNQIIKIQNFAVFIHNFKRKGGIGGYSAGERIIDIIASDIVPVGDIYKRWIILGLNKIVRMYSPVSILDIRVRQGYSPLSFQTLMPAPRGPDRLERIEEESRQDHQYPISEQPLSQTRGDNPTDPKESKKASGVVESMNKELKKIIGQVRDQAEHLKTAVQMAAMQMLKDTINEEAAEWDRIHPVHAGPIAPLTEICKEMEKEGKISRIGPENPYNTPVFAIQVRDQAEHLKTAVQMAVFIHNFKRKGGIGGKKKDSTKWRKLVDFRELNKRTQDFWEVQLGFSALAWDDLRSLCLFSYHRLRDFILIVARTCRHSRIGITRQRRGRNGSSRSAAPKISFDPIPIHYCAPAGFAILKCNNKTFNGEKDWHLGQGVSIEWRKKSYSTQVDPDLADQPSLYPPLASLKSLFGNDPSSQAARRAILGQIVRRRCEYQSGHNKVGSLQYLALSQPKTACYKCYCKKCCYHCQVCFLKKGLGIRDYGKQIAGADCVASRQDEDAAKYHSNWRTMASEFNLPPIVAKEIVASCDKCNEWTLELLEELKHEAVRHFPRPWLHGLGQHDIISLWDQSLKPCVKLTPLCVTLNCTNANLLKSYSTQVDPDLADHLIHLHYFDCFSDSAIHPMGLHGMEDEEREVLKWKFDSHLALRHIASSPIDTVPVKLKPGMDGPKVKQWPLTEEKIKAIWPSNKGGPGNFLQSRPEPTAPPAENFRFGISKKAKGWFYRHHYESQHPKVSSEVHIPLSMMTACQGVGGPSHKARVLAEAMSQVNNANIPPIVPKEIVANCDKCQLKGEAMHGQVDCSPSEGSRQARKNRRRRWRERQRQIRAISEWILGQIREPRGSDIAGTTSTLQEQIAWMTNNPPGIKQEFGIPYNPQSQGVVESMNKELKKIIGRQEILDLWVYNTQGFFPDWQNYTPGPGIRYPSRARQRQIHAISERILSNFLGRPAEPVPLQLYKTLRAEQATQEVKNWMTDTLLVQNANPDCEKVYLAWVPAHKGIGGNEQVDKLVSAGIRKTDPNPQEIDLENVTENFNMWKNNMVEQMQEAGYAILKCNNKKFNGTGPCKNVSTVQCTHGLELKNSAVSLLNATAIAVAEWTDRVIEVVQSQHPKVSSEVHIPLGDARLVIKTYWGLHTGAAMGGKWSKCSLVGWPAVRERIRQTPPAAEGVLKTGKYSRMRSAHTNDVKQLTEVVQKIATESSWEGLKYLWNLLLYWGLELKNSAVSLLNATAIVLPEKEGWTVNDIQKLVGKLNWASQIYAGRAIEAQQHLLQLTVWGIKQLQARVLAIERYLALQDSGSEVNIVTDSQYALGIIQAQPDKSEREISNYTNQIYKILTESQNQQDRNEQELLAPTKAKRRVVQREKRAVGIGAMFFGFLGAAKPKMIGGIGGFIKVRQYDQILIEICGQKAISYHRLRDFILIVARIVELLGHSSLRGLRRGTLNAWVKVVEEKGFNPEVIPMFTALSEGATLE

SEQ ID NO: 402 - DNA, 5925 bp, Artificial
  HIV cassette C2
  CDS (10)..(5910)
ggatccaccatgctcgagagcaacacagccgctaacaataccgattgcgtgtggctgaaagcccaggaagaggaagaagtgggatttcctgtgagaccccaagtgcctagagccgggagggctatcctcaacattcccacgaggattaggcaaggccttgagagagccctcctagccgccgaatgggataggattcaccctgtgcacgctggccctatcgctcccggccaaatgagagagcccaggggaagcgatatcgctggcacaaccctcaggcccatgacatataaggccgctattgacctcagcttgtttctgaaagagaaaggcggactggatggcctcatctatagcaagaaagctgctatggaacaggctcccgaagaccaaagctctcagagagagccttacaatgagtggaccctggagctcctggaagagctcaagcacgaggctcaaggccaatggaccttccaaatctttcaggaaccctttaagaatctgaaaaccggaaagtatgccagaatgagaggcgctcacacaaactggatgacagataccctcctggtccagaatgccaatcccgattgcaagtccatcctcaaggctctgggacccggagcctcactggaagagcctgaggtcatccctatgttctcagccctcagcgaaggcgctaccccccaagacctgaatatgatgctcaacaccgtcggcggacaccaatccaccctccaggaacagattggctggatgacaaataaccctcccatccctgtcggagagatttacaaaaggtggattatcctcggcctgactagaatcccccatcccgccggcctcaagaaaaagaaaagcgtcaccgtcctggatgtgggagacgcttacttcagcgtccccctcgacgaaggccaaagggaaacctgggaggcttggtggatggaatactggcaggctacctggattcctgagggggagtttgtgaatacccctcccctcgtgtttcccgattggcaaaactatacccctggccctggcacaaggtatcccctcacctttggatggtgctttaagctcgtgcctgtggaccccaaactgtggtaccaactggaaaaggaccccattgtcggagtcgaaaccttttacgcggacggagccgccaacagagagacaaagctcggccaaaacgtccagggacagatggtgcatcagcctattagccccaggaccctcaacgcttgggtcaaggtcatcgaagagaaaggctttagcgacaccgaagtgcataacgtctgggctacccatgcctgtgtgcctaccgatcccaatccccaagagattctcctggagaatgtgacagagctcaaggatcagaaactcctcggcatttggggatgctccggcaaactcatttgcacaaccactgtgccttggaacagctcctggtccaacccagctggccataacaaagtgggaagcctccagtatctggctctgaaggctctgattacgcctaagaaaatcaaaccccctctgcctagcgttaagacaatcattgtgcatctgaatgagtccgtggaaatcaattgcacaaggcctaacaataacacaaggacagccgccgctagtgaagtacagaataagtccagacagaaaacccagcaagccgccgccgatacaggcagctccagcaaggtcagccaaaactatcccattgtgtccaactttacctccaccactgtgaaagccgcttgttggtgggccaatatcaaacaggagtttggaatcccttacaatccccaaagccgaacattctatgtggatggcgctgccaatagggaaaccaaactgggaaaggctggctatgtgacagacagaggcagacagaaagtcgttagcggaatctggcagctcgactgtacccatctgaaaggcaaagtcattctggtagccgtccacgtcgcctccggctacattgaggctgaggtcggcaatgagcaagtggataagctcgtgatttccggaatcagaaaggtgctattcctcgacggaatcgataaggctcaggaagagcacgaagtcagggaaaggattaggcgagccgctcccgctgctgaaggcgtcggcgctgtctcccaggatctggataagtacggagccatcacctccacaagcggaacccaacagtcccagggaactgaaactggcgtcggcaaccctcagattttgggagagtccagcgctgtcctcggctccggctccatcgtcatctggggtaaaacccctaagtttaagctccccattcagaaagagacatgggaaacctggtggatggactattggcaagccgctgcttacagactgatcagctgtaacacaagcgttatcacacaggcttgccctaagattagctttgagcctatccctatccattactgtgcccctcctagctggatgggctatgagctccaccctgacagatggacagtgcaacccatcgtgctccccgaaaaggagtcctggacagtgaatgacattcagaaaacaattctgaaagccctcggcccaggcgctaccctggaggaaaatatgacagcatgtcagggagtgggaggccctggccataaggctagagtgtattacagagactccagggaccccatttggaaaggccctgccaaactgctctggaaaggcgaaggcgctgtggtcatccaagacattaagattggaggccaactgaaagaagccctcctggatacaggagccgatgacaccgtcctggaagatatcaatctgcctggcaagtggggaatcaaacagctccaggctagggtcctggctatcgagaggtatctgaaagatcaacagcttctgggaatctggagctgtagcggaaaggctgctatggaaaacagatggcaagtgatgatcgtctggcaagtggacaggatgaagattaggacatggaatagcctcgtgaaacaccatatgtatcttatctgtaccacagccgtcccctggaactccacctggagcaataagtccttcgaagagatttggaataacatgacctggattgaatggctgattatcgctatcgtcgtgtggaccattgtgtttatcgaatacaagaaactgctcaggcaaaggaaaatcgataggctcatcgaaaggctcaaccctggcctcctggaaaccgctgagggatgtaaacagatcctggaacagctccagcccgccctcaaggcaggcaccgaagagctctctagtagaaagctcctgagacagagaaagattgacagactgattgagagaatcagagagagagccgaagactccggcaatgagtccgagggagacacacccggaatcagataccaatacaatgtgctcccccaaggctggaagggctccccagccattttccaaagctccatgaccaaaatcctcatgatgcaaaggggaaactttaagggacagaaaaggattatcaagtgcttcaactgtggaaaggaaggccatctcgctaggaattgcagacctcccctggagagactgaacctggattgctccgaggatagcgacacctccggcacacagcaaagccaaggcacagagacaggagtgggactcgtggctgtgcatgtggccagcggatatatcgaagccgaagtgatccctgccgaaactggacaggaaaccgcttactttctcctcaagattaagcctgtggtcagcacacagctcctgctcaacggtagcctcgctgaagaggaaatcattatcagaagcgaaaactttaccaataacaaactggtcggcaaactgaattgggcttcccaaatctaccctggcatcaaagtgaggcaactgtgtaagctcctgagaggcaccaaagccctcacccctctgtgtgtgacactgaattgcacaaacgctaacctcatcaatgtgaatgctgctcaacccagaggcgataaccctaccgatcccaaagagtctaagaaagaggtcgcgtccaaggcagagacagacccttttgacgccgcccctagctccacctttctgggaaggtctgtcgaacccgtccccctccagctcccccctctggaaaggctccacctcgactgtagcgaagacagtgacgaactggataagtgggcctccctgtggaactggttcaatatcaccaactggctgtggtacattaagattttcattatgattgtgggaggcaataagattgtcaggatgtaccaacctgtctccatcctcgacattaagcaaggccctaaggaacccttcagggattacgtggacagattcgctaagctcctgtggaagggagagggagccgtcgtgattcaggacaactccgacattaaggtcgtgcccaggagaaaggctaagattatcgaactgaataagagaacccaagacttttgggaagcgcaactgggaatccctcaccatgctggactgaaaaagaaaaagtccgtgacagtggccgctatgagagtgaaagagacacagatgaactggcccaatctgtggaagtggggcacaatgattctgggactggtcatcatttgctccgcctccattaaggtcaaacagctctgcaaactgctcaggggtgcaaaggctctgatagacattgtgccactgacagaggaagccgaactggaactgctcatatggaagtttgactcccacctcgccctgagacatatcgccagggaactgcatcccgagtactacaaagactgcgctgctgtcgagctcctgggacgctccagcctcaaggaactgcgaaggggatgggaagccctcaagtatttgtggaacctcctgcagtattggggctctagcctggagcaactgcaatctgctctgaaaaccggatcagaggaactgaggtccctgtttaacacagtcgctaccctctggtgtgtgcatcaggagctctacaaatacaaagtggtcaaaatcgaacccctcggcattgcccctaccaaagccaaaaggagagtggtccagagagagaaaaggctcaccgatatcgtcacactcaccgaagaggctgagctggagctggaggaaaacagagagattctgaaggaacccgtccacggagtgtatagagtgctcgccgaagccatgagccaagccaacaatgccaacatcatgatgcagagaggcaatttcagaggcccaaagagaatcatcaaacaagaggaagagggggtcggcttccccgtcaggcctcaggtcccactgagacctatgacctacaaagcagccatcgatctgtccttcttcaaacagggacccaaagagcctttcagagactatgtggataggtttttcaaaaccctcagggctgagcaagcctcacaggaagtgaaaaactgggagaaaatcagactgagatctggtggcaaaaagaaatacaaactgaaacacattgtgtgggcctccagggaactggaaaggtttgcctcccagtatgccctcggcatcatcctagcccaacccgataagtccgagtccgagctcgtgagtcagattatcgaagagctcatcaagaagattgccgtcgccggatggacagacagagtcattgaggtcgtccaaagggcttggagagccattctgaatatccccaggagaatcagacagactagactcgccggaaggtggcccgtcaagataatccataccgataacggaagcaatttcacaagcactgccgtcaaggctgcctgctggtgggctgatgtgaaacagctcaccgaagtcgttcagaaaatcgctaccgaaagcattgtgatatggggaaagacacccaagttcagacagcctatcgctgccgccagcaacgagaacatggacgccatggctgcttgaagatctgaattc

SEQ ID NO: 403 - protein, 1967 aa, Artificial
  HIV cassette C2
MLESNTAANNTDCVWLKAQEEEEVGFPVRPQVPRAGRAILNIPTRIRQGLERALLAAEWDRIHPVHAGPIAPGQMREPRGSDIAGTTLRPMTYKAAIDLSLFLKEKGGLDGLIYSKKAAMEQAPEDQSSQREPYNEWTLELLEELKHEAQGQWTFQIFQEPFKNLKTGKYARMRGAHTNWMTDTLLVQNANPDCKSILKALGPGASLEEPEVIPMFSALSEGATPQDLNMMLNTVGGHQSTLQEQIGWMTNNPPIPVGEIYKRWIILGLTRIPHPAGLKKKKSVTVLDVGDAYFSVPLDEGQRETWEAWWMEYWQATWIPEGEFVNTPPLVFPDWQNYTPGPGTRYPLTFGWCFKLVPVDPKLWYQLEKDPIVGVETFYADGAANRETKLGQNVQGQMVHQPISPRTLNAWVKVIEEKGFSDTEVHNVWATHACVPTDPNPQEILLENVTELKDQKLLGIWGCSGKLICTTTVPWNSSWSNPAGHNKVGSLQYLALKALITPKKIKPPLPSVKTIIVHLNESVEINCTRPNNNTRTAAASEVQNKSRQKTQQAAADTGSSSKVSQNYPIVSNFTSTTVKAACWWANIKQEFGIPYNPQSRTFYVDGAANRETKLGKAGYVTDRGRQKVVSGIWQLDCTHLKGKVILVAVHVASGYIEAEVGNEQVDKLVISGIRKVLFLDGIDKAQEEHEVRERIRRAAPAAEGVGAVSQDLDKYGAITSTSGTQQSQGTETGVGNPQILGESSAVLGSGSIVIWGKTPKFKLPIQKETWETWWMDYWQAAAYRLISCNTSVITQACPKISFEPIPIHYCAPPSWMGYELHPDRWTVQPIVLPEKESWTVNDIQKTILKALGPGATLEENMTACQGVGGPGHKARVYYRDSRDPIWKGPAKLLWKGEGAVVIQDIKIGGQLKEALLDTGADDTVLEDINLPGKWGIKQLQARVLAIERYLKDQQLLGIWSCSGKAAMENRWQVMIVWQVDRMKIRTWNSLVKHHMYLICTTAVPWNSTWSNKSFEEIWNNMTWIEWLIIAIVVWTIVFIEYKKLLRQRKIDRLIERLNPGLLETAEGCKQILEQLQPALKAGTEELSSRKLLRQRKIDRLIERIRERAEDSGNESEGDTPGIRYQYNVLPQGWKGSPAIFQSSMTKILMMQRGNFKGQKRIIKCFNCGKEGHLARNCRPPLERLNLDCSEDSDTSGTQQSQGTETGVGLVAVHVASGYIEAEVIPAETGQETAYFLLKIKPVVSTQLLLNGSLAEEEIIIRSENFTNNKLVGKLNWASQIYPGIKVRQLCKLLRGTKALTPLCVTLNCTNANLINVNAAQPRGDNPTDPKESKKEVASKAETDPFDAAPSSTFLGRSVEPVPLQLPPLERLHLDCSEDSDELDKWASLWNWFNITNWLWYIKIFIMIVGGNKIVRMYQPVSILDIKQGPKEPFRDYVDRFAKLLWKGEGAVVIQDNSDIKVVPRRKAKIIELNKRTQDFWEAQLGIPHHAGLKKKKSVTVAAMRVKETQMNWPNLWKWGTMILGLVIICSASIKVKQLCKLLRGAKALIDIVPLTEEAELELLIWKFDSHLALRHIARELHPEYYKDCAAVELLGRSSLKELRRGWEALKYLWNLLQYWGSSLEQLQSALKTGSEELRSLFNTVATLWCVHQELYKYKVVKIEPLGIAPTKAKRRVVQREKRLTDIVTLTEEAELELEENREILKEPVHGVYRVLAEAMSQANNANIMMQRGNFRGPKRIIKQEEEGVGFPVRPQVPLRPMTYKAAIDLSFFKQGPKEPFRDYVDRFFKTLRAEQASQEVKNWEKIRLRSGGKKKYKLKHIVWASRELERFASQYALGIILAQPDKSESELVSQIIEELIKKIAVAGWTDRVIEVVQRAWRAILNIPRRIRQTRLAGRWPVKIIHTDNGSNFTSTAVKAACWWADVKQLTEVVQKIATESIVIWGKTPKFRQPIAAASNENMDAMAA

SEQ ID NO: 404 - DNA, 17244 bp, Artificial
  HIV complete savine
  CDS (1)..(17244)
atgacaggcccttgcacaaacgtcagcaccgtgcaatgcacacacggaatcagacccgtcgtgtccacccaactgctcctgaatggctccctgagaagcctctacaataccgtcgccacactgtggtgcgtccaccaaaggattgacgtcagggacacaaaggaagccctcgacaaaatcgaactcggcgatggcggaggcgctgaaaggcaaggcacctccagctccttcaactttccacaaatcacactgtggcaaaggcctctggtcaccgaacccttcagaaaaaagaatcccgatatggtgatttaccagtacatggacgatctgtatgtgggaagcgatctggaaatcggacagcattttaccacacccgataagaaacaccaaaaggaaccaccattcctctggatgggatacgaactgcatcccgataggtggaccgtccagcctcttaatttccctcagattaccctctggcagcgtcccctcgtgacaatcaaaatcggcggacagctcatagaggctctgctcgacacaggctcctatggcagaaagaaacgtaggcaacgtagacgcgctcctcagagcagcaaggatcaccaataccctatctctgagcaacccctctccttctttagggaaaacctggctttccagcaaggtaaagccagagagttttccagcgaacagacaagagccaatagctccgcctccaggaagagcccccaaatctccggcgaaagctccgtcattctgggatctggcaccaaaaacgccgctactagaagaatcgaagtgaaagataccaaagaggctttggataagattgaggaggtgcaaaagaaaagcgagcaaaagacacaacaggctgccgctaaagccggatacgtcaccgataggggaaggcaaaagattatctccctgacagagacaaccaatcagaaaaccgaactgcatgccattcaagaagccactaccacactgttttgcgccagcgatgccaaagcctatgagacagaggtccacaatgtgtgggccacacacgcttgcgtccccgctgacgatacagtgctggaggagatgaacctccccggaaaatggaagcctaagatgattggcggaatcggcggattcattaaggtgagaaaaatcggacccgaaaacccttacaataccccaatcttcgctatcaagaaaaaggactccaccaaatggagaaagctcgtggatttcagagttaggattatcaatatcctctaccaaagcaatccctatcctagctccgaaggctccaggcaaaccagaaagaataggagaaggagatggggaggcgaacggggtagggataggtccgtgagactggtcaacggattcttagccctcgcctgggacgatctgagaaacctctgcctcttcgaaaacctctgggtcaccgtctactatggcgtccccgtctggagagaggctgccacaaccctcttctgtgcctccgacgctaaggcttacgctgccatggctggcagaagcggcggcacagacgaagagctcctgagggctatcagaatcattaacattctgtatcagtccaacccttacccttccgctagtatgagaatcagaacctggaacagcctggtcaagcatcacatgcacatctccaagaaagccaaaggctggttctataggcatcactttgaggagtccgagctcgtgaatcagattatcgaaaagctcatcaaaaaggaaaaggtctacctatcatgggtaccagcccacaagggaatcggacaaaccaaagagctccagaaacagattatcaaaatccaaaactttagggtctactatagggatagcagagaccctatctggaagggacccaaaagctttgaggaaatctggaacaatatgacatggattgagtgggagagagagattagcaattacacaagccaaatctataagattctgaaacccgaacccacagcccctcccgctgagaatttcagattcggtgaggaaactacaccctcccaaaagcaagagcaaaaggataaggagcaatacgatcagattcttattgagatttgcggcaagaaagctattggtacggtgctcgtgggacctacccctgtgaatatcattggcagaatttacgaaacctatggcgatacctgggagggcgtcgaggctctgatcagaatcctccagcaactgatgtttatccatttcagaatcggatgttttcattgccaagtgtgttttctcaccaaaggtctcggcattagccacggaaggaaaaagagaaaacagagaaggggagctccccaagctgccatggaccccgtggaccccaagctggagccttggaaacaccctggctcccagcctaagacagcctgttacaaatgctattgcaaaaagtgccctagcgaagagacaacccctagccagaaacaggaacagaaagacaaagaactctacccccctttagccagcctcaagtccctgtttggcaatgacaatttcaatatgtggaagaatgacatggtggaacagatgcaagaagacattatcttactatgggaccaaagcctcaagccttgcgtcaagctcgacgtcggcgatgcctatttctccgtgcctctggataaaaacttcagaaagtataccgctttcacaatccctagcacaaacaatgagcaactgaaaggcgaagccatccatggccaagtgaattgctcaccaggcatttggcaactggattgcacacacctggagggaaagattatccctaaggtcaagcaatggcctctgacagaggaaaagattaaggctctgactgagatttgcaaagagatggaggaagagggaaagattagcatggatgacctctacgtcggctccgacctggagattggccaacataggaccaaaatcgaagagctcagggaacacctcctgaaatggggactcaccgaaaccacaaaccaaaagactgagctccaagctatccatctggctctgcaagactccggcttagaggtcaacattgtgacagacattcccgctgagactggtcaagagaccgcctttttcattctgaaactggctggcagatggcctgtgaaagtcattcacacagacaatggcaggacaaagattgaggaactgagaccgcatctgctcaaatggggcttcacaacccctgacaaaaagcatcagaaagagcctccctttctgtctagtgtcaagaaactgacagaggataagtggaacgaaccccagaaaatcaagagacgcagagaaaatcacacaatgaatggccatactgccacagagtcccagaatcagcaagacagaaacgaaaaggaactgctggagctcgacaaatgggcaagcctctggaattggtttaacattaccgacaccggaaatagctccaaagtgtcccagaattaccctatcgtccagaatgtccaaggccaaatggtccaccaacccctctcccccagactcatcggactgagaatcgttttcgctgtgctcagcattatcaatagggtcaggcaaggctatagccctctgtccttccaaaccctccccctcatccatctgcaatactttgactgtttcgctgactccaccattaggagagccatcttgggacacatagtgagaaggagatgcgaatacgctgtgggactcggagccatgttccttggctttctgggtgccgctggctccaccatgggcgctgcctccatgacactgacagtgcaagcctatgaccctagcaaagacctcattgctgagattcagaaacagggccagggtcagtggacatttcagattttccaagagcctttcaaaaacggaaccgtcctggtcggccctacacccgtcaacatcatcggaaggaacatgctgacacagcttggccgcactctcaactttcccattagcaaaggcagccctgctatctttcagtccagcatgccacagattctggagccttttaggataaaaaaccctgagatggtcatctatcagtatcctagccctctgacattcggatggtgtttcaaactggtccccgtggaccccagcgaagtggaagagatcaacaagggcgaaaacaattgccccctgtttaggaaatacacagcctttaccattccctccatcaataacgaaacccctggcattaggtatcagtataacgtcctgcctcagggatggggaagcacaatgggagccgccagcatgaccctcaccgtccaggctaggctactgctcagcggaatcgtccagcaacagagcaatctgctggaggagaatagggaaatcctcagagagcctgtgcatggcgtctactacgatccctccaaggatctggtcgctgaaatccaaaagcaaggcagagaggaactgtccaccatggtggatatgggaaactacgacctcggagtggacaataacctcgccgctattagaatcctgcaacagctcatgttcattcactttaggattggctgccagcactccaggattggcatcatccgtcagagaagggccagagctcccaggaaaaagggatgctggaagtgtggcagagagggacaccagatgaaggattgcactgagagacaggctaactttctgggaaaggatgccagactggttatcaaaacctattggggactgcataccggtgagagagactggcacctcggccatggcgtcagcattgagtggaggataagggaaagggctgaggatagcggcaacgaaagcgaaggcgacacagaagagctcagcacattggtggacatgggcaattacgatctgtctagccctgcccccaggggacccgataggctggagagaatcgaagaggaaggcggagagcaaggcagaggcagaagcgtcaggctcgtgaatggcagagaggtcgaggaagtcaatgagggagagaataactgtctgcttcaccctatcagtcaacatggcatggaagacgaagagagagaggtcaatagcgatatcaaagtggtccccagaaggaaagccaaaatcattagggattacggaaagcaaatggctggcgatgactgtgtggccagcttctcttccgagcaaacaggggctaactcctctacaagcagaaagctgggagacggaggcggagccgacagacagggaacaagctccagctgtttcaattgcggcaaagagggacacattgccaaaaactgtagggcccctcgcaagaaaggttgttggaaatgcggaaaggaaggccatcaaatgaaagactgtaccgaaaggcaagccaatttcctcggcaaaatctggccctccaacaaaggcagacccggaaactttctccaaagcaaatggctctggtatatcaaaatctttatcatgatcgtcggtggactgattggcctcaggattatctttgccgtcctgtccatcgttaacggagccgtgagccgagacctcgataaacatggcgctattacaagctccaataccgctgccaataacgctgactgtgtctggctgaaggctgctgccatgacacccctggagatcatcgctatcgtcgcctttatcgtcgccctcatcatagccattgtggtctggacaatcgtctacattgagtatgtcgacatgctcgagaatatgctcacccaaatcggatgcacactgaatttccctatctcccccattgagacagtgcctgtgaaactgaaacccggaatggatggcgccgccacctttaggcctggcggaggcaatatcaaagacaattggagaagcgaactgtataagtataaggtcgtgaagattaagcctctgggaatcacatggattcccgaatgggagttcgtcaacacacccccactggtcaagctatggtatcagctggagaaagaccctatcgttggcgttgagcctcaggatctcaacacgatgctgaatcttgtaggaggccatcaggccgctatgcaaatgctgaaagagacaatcaatgaggaagcctctgtcctgtttctggatggcattgacaaagctcaagaggaacatgaaaagtatcactccaactggaggacaatggccaacgactttaatctgatgaagcatctcgtctgggcctctagggagctggagagattcgctctgaatcccagcctgctggagacatccgaaggctgtcagcaaattgctgaggaagagattatcattaggtccgagaatttcacaaacaatgtcaaaaccattatcgtccaactcaacgaaagcgtcgagattaacatgggcgctagggctagtgtcctcagaggcggcaagctggacgcctgggaaaagattaggctcaggcctggcggaaagaaaaagtataggctcaaggagaagggaggcctggagggactggtttactccaaaaagaggcaagacattctggatctgtgggtgtataacacacagggattcactagatggggaaccatgatcctcggcttggtgattatctgtagcgccagcgagaatctgtgggtgacagtgtattacggagtgcctgtgtggaggagacagctcctgtccggcattgtgcaacaacaaaataacctcctgagggctatcgaagcccaacagcatctgctccagctcaccgtctgggtcaggcatttccccaggccttggctccacggcctgggacagtacatctatgagacatacggagacacatgggcgggagtggaagccctcacagccctcatcacacccaaaaagattaggcctcccctcccatccgtgaaaaagctcaccgaagacagatggaatgagcctcaaaagacatatagcgctggcgaaaggattatcgatatcattgcatccgacattcagactaaggaactgcaaaagcaaatcctaaagattcagaatttcgctgtgtttatccataactttaagaggaagggaggcattggcggctactccgccggagagagaatcattgacattatcgccaccgatatcattcccgtgggcgaaatctataagagatggatcattctgggactcaacaaaatcgtgagaatgtatctacccgtcagcattctggatatcagagtgagacagggatactcccccctcagctttcagacactgctgcccgctcccagaggccctgacagactcggaggcattgaggaagagtccagccaggaccatcagtatcccattcccgaacagcctctgcctcagacaaggggagacaatcccacagaccctaaggaaagcaaaaaggctagtggaggggtcgagtccatgaataaggaactgaaaaagattatcggacaggtcagggaccaggctgagcacctgaaaaccgctgtgcaaatggctgccatgcagatgctcaaggataccattaacgaagaggctgccgagtgggacagagtccatcccgtccatgccgggcccgttccccctctcaccgagatttgtaaagaaatggaaaaagaaggcaaaatctccaagattggccctgagaatccctataacacacccatctttgccattcaagtgagagagcaagccgaacacctcaagacagccgtccagatggcagtcttcattcacaatttcaaaaggagaggcggaatcggaggcaaaaagaaagatagcacaaagtggaggaaactggtagactttagggagctcaacaaacgtacacaggatttctgggaggtccagctcggctttttggctctggcttgggatgacctcaggagcctgtgtctgttcagctatcacagactgagagactttatcctcatcgttgccagaatctgccgacatagcagaatcggcatcactaggcaacgtagaggtaggaacggcgcctccagttccgctgcccccaaaatctccttcgaccccattcccattcactattgcgctcccgctggcttcgctatcctcaagtgtaacgataagaacttcaatggcgaagaggattggcatctgggacagggagtgtccatcgaatggagacagaaaagctatagcacacaggtggaccctgacctcgccgatcagcctagcctctatcctcccttagcttccctgaaaagcctcttcggaaacgatcccttatcccaagccgctagaagggctatcctcggccatatagtcaggagaaggtgtgagtatcagtccggacacaataaggtcggctccctgcaatacctcgcactcagtcaacccacaaccgcttgctacaagtgttactgtaagaaatgttgcttccactgtcaggtctgcttcctgaagaagggactgggaatcagggattacggaaagcaaatggctggcgatgactgtgtggccagcaggcaagacgaagacgcagccaagtaccatagcaattggagaaccattggcaatgagtttaacctcccccctatcgtccctaaggaaatcgtcgcaaattgcaataagtgtaacgaatggacactggaactgctggaggaactgaaacatgaagccgtgagacactttcccagaccctggctgcatggcctcggtcaacacgatatcattagcctctgggatcagtccctgaaaccctgtgtgaaactgacacccctctgcgtcaccctcaactgtaccaatgccaatctgatgaagagatactccacccaagtggaccccgatctggctgaccaactgattcacctccactatttcgattgctttgccgatagcgcaatccatcccatcggccaacacggaatggaggatgaggatagggaagtgctgaaatggaaattcgatagccatctggctctcaggcatatcgcttctagtcctatcgataccgtccccgtcaagctcaagcctggcatggacggacccaaagtgaaacactggcccctcaccgaagagaaaatcaaagccatttggcctagcaacaagggaaggcctggcaatttcccgcagtccaggcctgagcctaccgcacccccagccgagagctttagattcggcattagcaaaaaggctaagggatggttttacagacaccattacgatagccgacaccctaaggtcagctccgaggtccacattcccctcggcatgatgaccgcttgccaaggcgtcggcggacccagtcacaaagccagggtactggcagaggctatatcccaggtgaacaacgctaacattcctcccattgtggccaaagagattgtggcaaactgtgacaaatgccagctcaagagtgaggctattcacggacaggtgaactgtagcccttccgagggaacaagacagactaggaagaacagacgtagaaggtggcgtgcgaggcaaaggcaaatccactccatctccgagaggattctgggacagatgagggaacccagaggctccgacattgccggtactacaagcacactgcaagagcaaatcgcatggatgacaagcaatccccctagcattcaacaagagtttggcattccctataaccctcagtcccagggcgtcgtggaaagcatgaacaaagagctaaagaaaatcattggcagacaggagatcctcgatctctgggtctaccatacccaaggctatttccctgactggcagaattacacacccggacccggagtcagataccctagcagagaaagacagagacagattcattctattaacgaatggattctcagcaactgcctcggcagatccgctgagcctgtgcctctgcaactgtataagacactgagagccgaacaggctacccaagaggtcaagaattggatgaccgagacactgctcgtgcaaaacgctaaccctgactgtgagagagtgtatctggcttgggtccccgctcataaaggcattggcggaaacgaacaggtggacaaactggtcagcgctggcattaggaaaacagaccctaaccctcaggaaatccatctggaaaacgtcaccgagaactttaacatgtggaaaaacgatatggtggagcaaatgcatgaggctggctatgccattctgaaatgcaataacaaaaggttcaacggaactggacccagtaagaatgtgtccaccgtccagtgtacccatggcctagagctcaagaatagcgctatctccctgctcaacgctaccgctatcgctgtggctgggtggaccgatagggttatcgaagtggttcagtcccggcatcccaaagtgtccagcgaagtgcatatccctctgggagacgctaggctcatcattaggacatactggggcctccacacaggcgctgctatgggcggtaaatggtccaagtgctccctcgtcggatggcccgcagtgagagagagaatcagacagacaccccctgccgctgagggagtgctcaagaccggcaagtactctaggaagaggggtgcccataccaatgacgtcaagcaactgacagaggctgtgcaaaagattgccacagagtctagctgggagggtctgaaatactgggggaatctgctccagtactggggccaggaactgaaaatctccgccgtcagcctcctgaatgccacagccattgagctgcctgagaaagaaagctggaccgtcaacgatatccaaaagctcgtgggaaagctcaactgggcatcccagatttaccccggaagagccattgaggctcagcaacacatgctgcaactgacagtgtggggcattaagcaactgcaagccagagtgctcgccattgagagatacctcgccctccaggatagcggattggaagtgaatatcgtcaccgatagccaatacgctctaggcatcattcaggctcagcctgacaaaagcgaaagggaaatctccaactataccaatcagatttacaagatcctcaccgaatctcaaaatcaacaggataggaatgagaaagacctcctggctcccacaaaggctaagagaagggtcgtgcaaagggaaaagcgtgccgtcggcattggcgctatgtttctcggattcctcggcgctgccaaacccaaaatgatcggaggcattggaggctttatcaaagtcaggcagtatgaccaaatccttatcgaaatctgtggaaacaaggctatctcctaccataggctcagggatttcattctgatcgtcgctaggattgtggaactgctcggccgtagctccctgaaaggcctccagagaggcacactgaatgcctgggtgaaagtgattgaggaaaagggattcagtcccgaagtgattcccatgttttccgctctgtccgagggagccacactcgagatgctcgagagcaacacacccgctaataatgccgattgcgcgtggctgaaagcccaggaagaggaagaagtgggatttcctgtgagaccccaagtgcctagagcttggagggctatcctcaacattcccaggaggattaggcaaggctttgagagagccctcctagccgccgaatgggacagggttcaccctgtgcacgctggccctgtcgctcccggccaaatgagagagcccagaggaagcgatatcgctggcacaaccctcaggcccatgacatataaggccgctattgacctcagcttgtttctgaaagagaaaggcggactggaaggcctcatctatagcaagaaagctgctatggaacaggctcccgaagaccaaagccctcagagagagccttacaatgagtggaccctggagctcctggaagagctcaagaaagaggctcaaggccaatggacctaccaaatctttcaggaaccctttaagaatctgaaaaccggaaagtattccagaatgagaagcgctcacacaaactggatgacagaaaccctcctggtccagaatgccaatcccgattgcaagtccatcctcagggctctgggaaccggagccacactggaagagcctgaggtcatccctatgttctcagccctcagcgaaggcgctaccccccaagacctgaatacgatgctcaacatcgtcagcggacaccaatccaccctccaggaacagattggctggatgacaaataaccctcccatccctgtcggagagatttacaaaaggtggattatcctcggcctgactagaatcccccatcccgccggcctcaagaaaaagaaaagcgtcaccgtcctggatgtgggagacgcttacttcagcgtccccctcgacgaagaccaaaaggaaacctgggaggcttggtggacggaatactggcaggctacctggattcctgagtgggagtttgtgaatacccctcccctcgtgtttcccgattggcataactatacccctggccctggcataaggtatcccctcacctttggatggtgctttaagctcgtgcctgtggaccccaaactgtggtaccaactggaaaaggaacccattgtcggagccgaaaccttttacgtggacggagccgccaacagagagacaaagctcggccaaaacgtccagggacagatggtgcatcaggctattagccccaggaccctcaacgcttgggtcaaggtcgtcgaagagaaagcctttaacgaaaccgaagtgcataacgtctgggctacccatgcctgtgtgcgtaccgatcccaatccccaagagattctcctggagaatgtgacagagctcaaggatcagaaactcctcggcatttggggatgctccggcaaaatcatttgcacaaccactgtgccttggaacagctcctggtccaaccaagctggccataacaaagtgggaagcctccagtatctggctctgacggctctgattaagcctaagaaaatcaaaccccctctgcctagcgttaagacaatcattgtgcatctgaatgagtccgtggaaatcaattgcacaaggcctaacaataacacaaggaaagccgccgctagtgaagtacggaataagtccaaacagaaaacccagcaagctgccgccgatacaggcgactccagccaggtcagccaaaactatcccattgtgtccaactttacctccaccactgtgaaagccgcttgttggtgggccaatatcaaacaggagtttggaatcccttacaatccccaaagccaaacattctatgtggatggcgctgccaatagggaaacccaactgggaaaggcgggctatgtgacagacaaaggcagacagaaagtcattagcggaatctggcagctcgactgtacccatctggaaggcaaagtcattctggtagccgtccacgtcgcctccggctacattgaggctgaggtcggcaatgagcaagtggataagctcgtgagttccggaatcagaaaggtgctattcctcgacggaatcaataaggctcaggaagagcacgaagtcagggaaaggattaggcgaaccgctcccgctgctgaaggcgtcggcgctgtctcccaggatctggataagtacggagccctcacctccacaagcggaacccaacagtcccagggaactgaaactggcgtcggcaaccctcagattttgggagagtccagcgttgtcctcggctccggctccatcgtcatctggggtaaaacccctaagtttaagttccccattcagaaagagacatgggaagcctggtggacggagtattggcaagccgctgcttacagactgatcagctgtaacacaagcgttatcaaacaggcttgccctaagattacctttgaccctatccctatccattactgtgcccctcctagctggatgggctatgagctccaccctgacagatggacagtgcaacccatcgtgctccccgaaaaggactcctggacagtgaatgacattcagaaatcaattctgagagccctcggcccaggcgcttccctggaggaaatgatgacagcatgtcagggagtgggaggccctggccataaggctagagtgtattacagagactccagggaccccatttggaaaggccctgccaaactgctctggaaaggcgaaggcgctgtggtcatccaagacattaagattggaggccaactgatagaagccctcctggatacaggagccgatgacaccgtcctggaagatatgaatctgcctggcaagtggggaatcaaacagctccaggctagggtcctggctatcgagaggtatctgaaagatcaacagtttctgggactctggggctgtagcggaaaggctgctatggaaaacagatggcaagtgatgatcgtctggcaagtggacaggatgaagattaggacatggaatagcctcgtgaaacaccatatgtatattatctgtaccacaaccgtcccctggaactccacctggagcaataagtccttcgaagagatttggaataacatgacctggattcaatggctgattctcgctatcgtcgtgtggaccattgtgtatatcgaatacaagaaactgctcaggcaaaggagaatcgataggctcatcaaaaggctcaaccctggcctcctggaaaccgctgagggatgtaaacagatcctggaacagctccagcccgccctccagacaggcaccgaagagctctctagtagaaagctcctgaaacagagaaagattgacagactgattgagagaatcagagagagagccgaagactccggcaatgagtccgagggagacacacccggaatcagataccaatacaatgtgctcccccaaggctggaagggctccccacccattttccaaagctccatgacccaaatcctcatgatgcaaaggggaaactttaagggacagaaaaggattatcaagtgcttcaactgtggaaaggaaggccatctcgctaggaattgcagacctcccctagagagactgaacctggattgctccgaggatagcgacacctccggcacacagcaaagccaaggcacagagacagaagtgggactcgtggctgtgcatgtggccagcggatatatcgaagccgaagtgatccctgccgaaactggacaggaaaccgcttactttatcctcaagattaagcctgtggtcagcacacagctcctgctcaacggtagcctcgctgaagaggaaatcattatcagaagcgaaaactttaccgataacaaactggtcggcaaactgaattgggcttcccaaatctacgctggcatcaaagtgaagcaactgtgtaagctcctgagaggcaccaaagccctcactcctctgtgtgtgacactgaattgcacaaacgctaacctcatcaatgtgaatgctgctcaaaccagaggcgataaccctaccggtcccgaagagtccaagaaagaggtcgcgtccaagacagagacagacccttgtgacgccgcccctagctccaactttctgggaaggtctgccgaacccgtccccctccagcccccccctctggaaaggctccacctcgactgtagcgaagactgtggcgaactggataagtgggcctccctgtggaactggttcaatatcaccaactggctgtggtacattaagattttcattatgattgtgggaggcaataagattgtcaggatgtactcacctgtctccatcctcgacattaagcaaggccctaaggaacccttcagggattacgtggacagattcgctaagctcctgtggaagggagagggagccgtcgtgattcaggacaactccgacattaaggtcgtgcccaggagaaaggctaagattatcgaactgaataagagaacccaagacttttgtgaagtgcaactgggaatccctcaccctgctggactgaagaagaaaaagtcagtgacagtggccgctatgagagtgaaagagacacagatgaactggcccaatctgtggaagtggggcacaatgattctgggactggtcatcatttgctccgcctccattaaggtcagacagctctgcaaactgctcaggggtacaaaggctctgacagagattgtgacactgacagaggaagccgaactggaactgctcatatggaagtttgactcccgcctcgccctgagacatatcgccagggaactgcatcccgagttctacaaagactgcgctgctgtcgagctcctgggacgctccagcctcaagggactgcaaaggggatgggaaggcctcaagtatttgtggaacctcctgcagtattggggctctagcctggggcaactgcaacctgctctgaaaaccggatcagaggaactgaagtccctgtataacacaatcgctaccctctggtgtgtgcatcaggagctctacaaatacaaagtggtcaaaatcaaacccctcggcattgcccctaccagagccaaaaggagagtggtcgagagagagaaaaggctcaccgaaatcgtcccactcaccgaagaggctgagctggagctggaggaaaacagagagattctgagggaacccgtccacggagtgtatagagtgctcgccgaagccatgagccaagtcaacaatgccaacatcatgatgcagagaggcaatttcaaaggcctaaagagaatcatcaaacaagaggaagaggaggtcggcttccccgtcaggccccaggtcccactgagacctatgacctacaaaggagccgtcgatctgtccttcttcagacagggacccaaagagcctttcagagactatgtggataggtttttcaaaaccctcagggctgagcaagcctcacaggaagtgaaaaactgggagaaaatcagactgagacctggtggcaaaaagaaatacaaaatgaaacacattgtgtgggcctccagggaactggaaaggtttgcctcccagtatgccctcggcatcatcctagcccaacccgataagtccgagtccgagctcgtgaatcagattatcgaagagctcatcaagaagattgccgtcgccggatggacagacagaatcattgaggtcgaccaaagggcttggagagccattctgaatatccccaggagaatcagacagactagactcgccggaaggtggcccgtcaggacaatctataccgataacggaagcaatttcacaagcgctaccgtcaaggctgcctgctggtgggctgatgtgaaacagctcaccgcagtcgtccagaaaatcgctaccgaaagcattgtgatatggggaaagacgcccaagttcagactgcctatcgctgccgccagcaacgagaacatggagaccatggctgcttga

SEQ ID NO: 405 - protein, 5747 aa, Artificial
  HIV complete savine
MTGPCTNVSTVQCTHGIRPVVSTQLLLNGSLRSLYNTVATLWCVHQRIDVRDTKEALDKIELGDGGGAERQGTSSSFNFPQITLWQRPLVTEPFRKKNPDMVIYQYMDDLYVGSDLEIGQHFTTPDKKHQKEPPFLWMGYELHPDRWTVQPLNFPQITLWQRPLVTIKIGGQLIEALLDTGSYGRKKRRQRRRAPQSSKDHQYPISEQPLSFFRENLAFQQGKAREFSSEQTRANSSASRKSPQISGESSVILGSGTKNAATRRIEVKDTKEALDKIEEVQKKSEQKTQQAAAKAGYVTDRGRQKIISLTETTNQKTELHAIQEATTTLFCASDAKAYETEVHNVWATHACVPADDTVLEEMNLPGKWKPKMIGGIGGFIKVRKIGPENPYNTPIFAIKKKDSTKWRKLVDFRVRIINILYQSNPYPSSEGSRQTRKNRRRRWGGERGRDRSVRLVNGFLALAWDDLRNLCLFENLWVTVYYGVPVWREAATTLFCASDAKAYAAMAGRSGGTDEELLRAIRIINILYQSNPYPSASMRIRTWNSLVKHHMHISKKAKGWFYRHHFEESELVNQIIEKLIKKEKVYLSWVPAHKGIGQTKELQKQIIKIQNFRVYYRDSRDPIWKGPKSFEEIWNNMTWIEWEREISNYTSQIYKILKPEPTAPPAENFRFGEETTPSQKQEQKDKEQYDQILIEICGKKAIGTVLVGPTPVNIIGRIYETYGDTWEGVEALIRILQQLMFIHFRIGCFHCQVCFLTKGLGISHGRKKRKQRRGAPQAAMDPVDPKLEPWKHPGSQPKTACYKCYCKKCPSEETTPSQKQEQKDKELYPPLASLKSLFGNDNFNMWKNDMVEQMQEDIILLWDQSLKPCVKLDVGDAYFSVPLDKNFRKYTAFTIPSTNNEQLKGEAIHGQVNCSPGIWQLDCTHLEGKIIPKVKQWPLTEEKIKALTEICKEMEEEGKISMDDLYVGSDLEIGQHRTKIEELREHLLKWGLTETTNQKTELQAIHLALQDSGLEVNIVTDIPAETGQETAFFILKLAGRWPVKVIHTDNGRTKIEELRPHLLKWGFTTPDKKHQKEPPFLSSVKKLTEDKWNEPQKIKRRRENHTMNGHTATESQNQQDRNEKELLELDKWASLWNWFNITDTGNSSKVSQNYPIVQNVQGQMVHQPLSPRLIGLRIVFAVLSIINRVRQGYSPLSFQTLPLIHLQYFDCFADSTIRRAILGHIVRRRCEYAVGLGAMFLGFLGAAGSTMGAASMTLTVQAYDPSKDLIAEIQKQGQGQWTFQIFQEPFKNGTVLVGPTPVNIIGRNMLTQLGRTLNFPISKGSPAIFQSSMPQILEPFRIKNPEMVIYQYPSPLTFGWCFKLVPVDPSEVEEINKGENNCPLFRKYTAFTIPSINNETPGIRYQYNVLPQGWGSTMGAASMTLTVQARLLLSGIVQQQSNLLEENREILREPVHGVYYDPSKDLVAEIQKQGREELSTMVDMGNYDLGVDNNLAAIRILQQLMFIHFRIGCQHSRIGIIRQRRARAPRKKGCWKCGREGHQMKDCTERQANFLGKDARLVIKTYWGLHTGERDWHLGHGVSIEWRIRERAEDSGNESEGDTEELSTLVDMGNYDLSSPAPRGPDRLERIEEEGGEQGRGRSVRLVNGREVEEVNEGENNCLLHPISQHGMEDEEREVNSDIKVVPRRKAKIIRDYGKQMAGDDCVASFSSEQTGANSSTSRKLGDGGGADRQGTSSSCFNCGKEGHIAKNCRAPRKKGCWKCGKEGHQMKDCTERQANFLGKIWPSNKGRPGNFLQSKWLWYIKIFIMIVGGLIGLRIIFAVLSIVNGAVSRDLDKHGAITSSNTAANNADCVWLKAAAMTPLEIIAIVAFIVALIIAIVVWTIVYIEYVDMLENMLTQIGCTLNFPISPIETVPVKLKPGMDGAATFRPGGGNIKDNWRSELYKYKVVKIKPLGITWIPEWEFVNTPPLVKLWYQLEKDPIVGVEPQDLNTMLNLVGGHQAAMQMLKETINEEASVLFLDGIDKAQEEHEKYHSNWRTMANDFNLMKHLVWASRELERFALNPSLLETSEGCQQIAEEEIIIRSENFTNNVKTIIVQLNESVEINMGARASVLRGGKLDAWEKIRLRPGGKKKYRLKEKGGLEGLVYSKKRQDILDLWVYNTQGFTRWGTMILGLVIICSASENLWVTVYYGVPVWRRQLLSGIVQQQNNLLRAIEAQQHLLQLTVWVRHFPRPWLHGLGQYIYETYGDTWAGVEALTALITPKKIRPPLPSVKKLTEDRWNEPQKTYSAGERIIDIIASDIQTKELQKQILKIQNFAVFIHNFKRKGGIGGYSAGERIIDIIATDIIPVGEIYKRWIILGLNKIVRMYLPVSILDIRVRQGYSPLSFQTLLPAPRGPDRLGGIEEESSQDHQYPIPEQPLPQTRGDNPTDPKESKKASGGVESMNKELKKIIGQVRDQAEHLKTAVQMAAMQMLKDTINEEAAEWDRVHPVHAGPVPPLTEICKEMEKEGKISKIGPENPYNTPIFAIQVREQAEHLKTAVQMAVFIHNFKRRGGIGGKKKDSTKWRKLVDFRELNKRTQDFWEVQLGFLALAWDDLRSLCLFSYHRLRDFILIVARICRHSRIGITRQRRGRNGASSSAAPKISFDPIPIHYCAPAGFAILKCNDKNFNGEEDWHLGQGVSIEWRQKSYSTQVDPDLADQPSLYPPLASLKSLFGNDPLSQAARRAILGHIVRRRCEYQSGHNKVGSLQYLALSQPTTACYKCYCKKCCFHCQVCFLKKGLGIRDYGKQMAGDDCVASRQDEDAAKYHSNWRTIGNEFNLPPIVPKEIVANCNKCNEWTLELLEELKHEAVRHFPRPWLHGLGQHDIISLWDQSLKPCVKLTPLCVTLNCTNANLMKRYSTQVDPDLADQLIHLHYFDCFADSAIHPIGQHGMEDEDREVLKWKFDSHLALRHIASSPIDTVPVKLKPGMDGPKVKHWPLTEEKIKAIWPSNKGRPGNFPQSRPEPTAPPAESFRFGISKKAKGWFYRHHYDSRHPKVSSEVHIPLGMMTACQGVGGPSHKARVLAEAISQVNNANIPPIVAKEIVANCDKCQLKSEAIHGQVNCSPSEGTRQTRKNRRRRWRARQRQIHSISERILGQMREPRGSDIAGTTSTLQEQIAWMTSNPPSIQQEFGIPYNPQSQGVVESMNKELKKIIGRQEILDLWVYHTQGYFPDWQNYTPGPGVRYPSRERQRQIHSINEWILSNCLGRSAEPVPLQLYKTLRAEQATQEVKNWMTETLLVQNANPDCERVYLAWVPAHKGIGGNEQVDKLVSAGIRKTDPNPQEIHLENVTENFNMWKNDMVEQMHEAGYAILKCNNKRFNGTGPSKNVSTVQCTHGLELKNSAISLLNATAIAVAGWTDRVIEVVQSRHPKVSSEVHIPLGDARLIIRTYWGLHTGAAMGGKWSKCSLVGWPAVRERIRQTPPAAEGVLKTGKYSRKRGAHTNDVKQLTEAVQKIATESSWEGLKYWGNLLQYWGQELKISAVSLLNATAIELPEKESWTVNDIQKLVGKLNWASQIYPGRAIEAQQHMLQLTVWGIKQLQARVLAIERYLALQDSGLEVNIVTDSQYALGIIQAQPDKSEREISNYTNQIYKILTESQNQQDRNEKDLLAPTKAKRRVVQREKRAVGIGAMFLGFLGAAKPKMIGGIGGFIKVRQYDQILIEICGNKAISYHRLRDFILIVARIVELLGRSSLKGLQRGTLNAWVKVIEEKGFSPEVIPMFSALSEGATLEMLESNTPANNADCAWLKAQEEEEVGFPVRPQVPRAWRAILNIPRRIRQGFERALLAAEWDRVHPVHAGPVAPGQMREPRGSDIAGTTLRPMTYKAAIDLSLFLKEKGGLEGLIYSKKAAMEQAPEDQSPQREPYNEWTLELLEELKKEAQGQWTYQIFQEPFKNLKTGKYSRMRSAHTNWMTETLLVQNANPDCKSILRALGTGATLEEPEVIPMFSALSEGATPQDLNTMLNIVSGHQSTLQEQIGWMTNNPPIPVGEIYKRWIILGLTRIPHPAGLKKKKSVTVLDVGDAYFSVPLDEDQKETWEAWWTEYWQATWIPEWEFVNTPPLVFPDWHNYTPGPGIRYPLTFGWCFKLVPVDPKLWYQLEKEPIVGAETFYVDGAANRETKLGQNVQGQMVHQAISPRTLNAWVKVVEEKAFNETEVHNVWATHACVRTDPNPQEILLENVTELKDQKLLGIWGCSGKIICTTTVPWNSSWSNQAGHNKVGSLQYLALTALIKPKKIKPPLPSVKTIIVHLNESVEINCTRPNNNTRKAAASEVRNKSKQKTQQAAADTGDSSQVSQNYPIVSNFTSTTVKAACWWANIKQEFGIPYNPQSQTFYVDGAANRETQLGKAGYVTDKGRQKVISGIWQLDCTHLEGKVILVAVHVASGYIEAEVGNEQVDKLVSSGIRKVLFLDGINKAQEEHEVRERIRRTAPAAEGVGAVSQDLDKYGALTSTSGTQQSQGTETGVGNPQILGESSVVLGSGSIVIWGKTPKFKFPIQKETWEAWWTEYWQAAAYRLISCNTSVIKQACPKITFDPIPIHYCAPPSWMGYELHPDRWTVQPIVLPEKDSWTVNDIQKSILRALGPGASLEEMMTACQGVGGPGHKARVYYRDSRDPIWKGPAKLLWKGEGAVVIQDIKIGGQLIEALLDTGADDTVLEDMNLPGKWGIKQLQARVLAIERYLKDQQFLGLWGCSGKAAMENRWQVMIVWQVDRMKIRTWNSLVKHHMYIICTTTVPWNSTWSNKSFEEIWNNMTWIQWLILAIVVWTIVYIEYKKLLRQRRIDRLIKRLNPGLLETAEGCKQILEQLQPALQTGTEELSSRKLLKQRKIDRLIERIRERAEDSGNESEGDTPGIRYQYNVLPQGWKGSPPIFQSSMTQILMMQRGNFKGQKRIIKCFNCGKEGHLARNCRPPLERLNLDCSEDSDTSGTQQSQGTETEVGLVAVHVASGYIEAEVIPAETGQETAYFILKIKPVVSTQLLLNGSLAEEEIIIRSENFTDNKLVGKLNWASQIYAGIKVKQLCKLLRGTKALTPLCVTLNCTNANLINVNAAQTRGDNPTGPEESKKEVASKTETDPCDAAPSSNFLGRSAEPVPLQPPPLERLHLDCSEDCGELDKWASLWNWFNITNWLWYIKIFIMIVGGNKIVRMYSPVSILDIKQGPKEPFRDYVDRFAKLLWKGEGAVVIQDNSDIKVVPRRKAKIIELNKRTQDFCEVQLGIPHPAGLKKKKSVTVAAMRVKETQMNWPNLWKWGTMILGLVIICSASIKVRQLCKLLRGTKALTEIVTLTEEAELELLIWKFDSRLALRHIARELHPEFYKDCAAVELLGRSSLKGLQRGWEGLKYLWNLLQYWGSSLGQLQPALKTGSEELKSLYNTIATLWCVHQELYKYKVVKIKPLGIAPTRAKRRVVEREKRLTEIVPLTEEAELELEENREILREPVHGVYRVLAEAMSQVNNANIMMQRGNFKGLKRIIKQEEEEVGFPVRPQVPLRPMTYKGAVDLSFFRQGPKEPFRDYVDRFFKTLRAEQASQEVKNWEKIRLRPGGKKKYKMKHIVWASRELERFASQYALGIILAQPDKSESELVNQIIEELIKKIAVAGWTDRIIEVDQRAWRAILNIPRRIRQTRLAGRWPVRTIYTDNGSNFTSATVKAACWWADVKQLTAVVQKIATESIVIWGKTPKFRLPIAAASNENMETMAA

SEQ ID NO: 406 - protein, 3011 aa, Artificial
  HepC 1a consensus polyprotein
MSTNPKPQRKTKRNTNRRPQDVKFPGGGQIVGGVYLLPRRGPRLGVRATRKTSERSQPRGRRQPIPKARRPEGRTWAQPGYPWPLYGNEGCGWAGWLLSPRGSRPSWGPTDPRRRSRNLGKVIDTLTCGFADLMGYIPLVGAPLGGAARALAHGVRVLEDGVNYATGNLPGCSFSIFLLALLSCLTVPASAYQVRNSTGLYHVTNDCPNSSIVYEAADAILHTPGCVPCVREGNASRCWVAMTPTVATRDGKLPATQLRRHIDLLVGSATLCSALYVGDLCGSVFLVGQLFTFSPRRHWTTQGCNCSIYPGHITGHRMAWDMMMNWSPTAALVMAQLLRIPQAILDMIAGAHWGVLAGIAYFSMVGNWAKVLVVLLLFAGVDAETHVTGGNAGRTTSGLVSLLTPGAKQNIQLINTNGSWHINSTALNCNESLNTGWLAGLFYQHKFNSSGCPERLASCRRLTDFDQGWGPISYANGSGPDQRPYCWHYPPKPCGIVPAKSVCGPVYCFTPSPVVVGTTDRSGAPTYSWGANDTDVFVLNNTRPPLGNWFGCTWMNSTGFTKVCGAPPCVIGGAGNNTLHCPTDCFRKHPEATYSRCGSGPWITPRCLVDYPYRLWHYPCTINYTIFKVRMYVGGVEHRLEAACNWTRGERCDLEDRDRSELSPLLLSTTQWQVLPCSFTTLPALSTGLIHLHQNIVDVQYLYGVGSSIASWAIKWEYVVLLFLLLADARVCSCLWMMLLISQAEAALENLVILNAASLAGTHGLVSFLVFFCFAWYLKGRWVPGAVYALYGMWPLLLLLLALPQRAYALDTEVAASCGGVVLVGLMALTLSPYYKRYISWCLWWLQYFLTRVEAQLHVWVPPLNVRGGRDAVILLMCVVHPTLVFDITKLLLAVFGPLWILQASLLKVPYFVRVQGLLRICALARKMIGGHYVQMAIIKLGALTGTYVYNHLTPLRDWAHNGLRDLAVAVEPVVFSQMETKLITWGADTAACGDIINGLPVSARRGREILLGPADGMVSKGWRLLAPITAYAQQTRGLLGCIITSLTGRDKNQVEGEVQIVSTAAQTFLATCINGVCWTVYHGAGTRTIASPKGPVIQMYTNVDQDLVGWPAPQGSRSLTPCTCGSSDLYLVTRHADVIPVRRRGDSRGSLLSPRPISYLKGSSGGPLLCPAGHAVGIFRAAVCTRGVAKAVDFIPVENLETTMRSPVFTDNSSPPAVPQSFQVAHLHAPTGSGKSTKVPAAYAAQGYKVLVLNPSVAATLGFGAYMSKAHGIDPNIRTGVRTITTGSPITYSTYGKFLADGGCSGGAYDIIICDECHSTDATSILGIGTVLDQAETAGARLVVLATATPPGSVTVPHPNIEEVALSTTGEIPFYGKAIPLEVIKGGRHLIFCHSKKKCDELAAKLVALGINAVAYYRGLDVSVIPTSGDVVVVATDALMTGYTGDFDSVIDCNTCVTQTVDFSLDPTFTIETTTLPQDAVSRTQRRGRTGRGKPGIYRFVAPGERPSGMFDSSVLCECYDAGCAWYELTPAETTVRLRAYMNTPGLPVCQDHLEFWEGVFTGLTHIDAHFLSQTKQSGENFPYLVAYQATVCARAQAPPPSWDQMWKCLIRLKPTLHGPTPLLYRLGAVQNEVTLTHPVTKYIMTCMSADLEVVTSTWVLVGGVLAALAAYCLSTGCVVIVGRIVLSGKPAIIPDREVLYREFDEMEECSQHLPYIEQGMMLAEQFKQKALGLLQTASRQAEVIAPAVQTNWQKLEVFWAKHMWNFISGIQYLAGLSTLPGNPAIASLMAFTAAVTSPLTTSQTLLFNILGGWVAAQLAAPGAATAFVGAGLAGAAIGSVGLGKVLVDILAGYGAGVAGALVAFKIMSGEVPSTEDLVNLLPAILSPGALVVGVVCAAILRRHVGPGEGAVQWMNRLIAFASRGNHVSPTHYVPESDAAARVTAILSSLTVTQLLRRLHQWISSECTTPCSGSWLRDIWDWICEVLSDFKTWLKAKLMPQLPGIPFVSCQRGYKGVWRGDGIMHTRCHCGAEITGHVKNGTMRIVGPRTCRNMWSGTFPINAYTTGPCTPLPAPNYTFALWRVSAEEYVEIRRVGDFHYVTGMTTDNLKCPCQVPSPEFFTELDGVRLHRFAPPCKPLLREEVSFRVGLHEYPVGSQLPCEPEPDVAVLTSMLTDPSHITAEAAGRRLARGSPPSMASSSASQLSAPSLKATCTANHDSPDAELIEANLLWRQEMGGNITRVESENKVVILDSFDPLVAEEDEREISVPAEILRKSRRFAQALPVWARPDYNPPLVETWKKPDYEPPVVHGCPLPPPRSPPVPPPRKKRTVVLTESTLSTALAELATKSFGSSSTSGITGDNTTTSSEPAPSGCPPDSDAESYSSMPPLEGEPGDPDLSDGSWSTVSSEAGTEDVVCCSMSYSWTGALVTPCAAEEQKLPINALSNSLLRHHNLVYSTTSRSACQRQKKVTFDRLQVLDSHYQDVLKEVKAAASKVKANLLSVEEACSLTPPHSAKSKFGYGAKDVRCHARKAVAHINSVWKDLLEDSVTPIDTTIMAKNEVFCVQPEKGGRKPARLIVFPDLGVRVCEKMALYDVVSKLPLAVMGSSYGFQYSPGQRVEFLVQAWKSKKTPMGFSYDTRCFDSTVTESDIRTEEAIYQCCDLDPQARVAIKSLTERLYVGGPLTNSRGENCGYRRCRASGVLTTSCGNTLTCYIKARAACRAAGLQDCTMLVCGDDLVVICESAGVQEDAASLRAFTEAMTRYSAPPGDPPQPEYDLELITSCSSNVSVAHDGAGKRVYYLTRDPTTPLARAAWETARHTPVNSWLGNIIMFAPTLWARMILMTHFFSVLIARDQLEQALDCEIYGACYSIEPLDLPPIIQRLHGLSAFSLHSYSPGEINRVAACLRKLGVPPLRAWRHRARSVRARLLARGGRAAICGKYLFNWAVRTKLKLTPIAAAGRLDLSGWFTAGYSGGDIYHSVSHARPRWFWFCLLLLAAGVGIYLLPNR

SEQ ID NO: 407 - DNA, 90 bp, Artificial
  HepC 1a segment 1
  CDS (1)..(90)
gccgctatgtccaccaatcccaaaccccaaaggaaaaccaaaaggaataccaataggagaccccaagacgtcaagtttcccggaggcgga

SEQ ID NO: 408 - protein, 30 aa, Artificial
  HepC 1a segment 1
AAMSTNPKPQRKTKRNTNRRPQDVKFPGGG

SEQ ID NO: 409 - DNA, 90 bp, Artificial
  HepC 1a segment 2
  CDS (1)..(90)
aacacaaacagaaggcctcaggatgtgaaattccctggcggaggccaaatcgtcggcggagtgtatctgctccccagaaggggacccaga

SEQ ID NO: 410 - protein, 30 aa, Artificial
  HepC 1a segment 2
NTNRRPQDVKFPGGGQIVGGVYLLPRRGPR

SEQ ID NO: 411 - DNA, 90 bp, Artificial
  HepC 1a segment 3
  CDS (1)..(90)
cagattgtgggaggcgtctacctcctgcctaggagaggccctaggctcggcgtcagggctaccagaaagacaagcgaaaggtcccagcct

SEQ ID NO: 412 - protein, 30 aa, Artificial
  HepC 1a segment 3
QIVGGVYLLPRRGPRLGVRATRKTSERSQP

SEQ ID NO: 413 - DNA, 90 bp, Artificial
  HepC 1a segment 4
  CDS (1)..(90)
ctgggagtgagagccacaaggaaaacctccgagagaagccaacccagaggcagaaggcaacccattcccaaagccagaaggcctgaggga

SEQ ID NO: 414 - protein, 30 aa, Artificial
  HepC 1a segment 4
LGVRATRKTSERSQPRGRRQPIPKARRPEG

SEQ ID NO: 415 - DNA, 90 bp, Artificial
  HepC 1a segment 5
  CDS (1)..(90)
aggggaaggagacagcctatccctaaggctaggagacccgaaggcagaacctgggcccaacccggatacccttggcctctgtatggcaat

SEQ ID NO: 416 - protein, 30 aa, Artificial
  HepC 1a segment 5
RGRRQPIPKARRPEGRTWAQPGYPWPLYGN

SEQ ID NO: 417 - DNA, 90 bp, Artificial
  HepC 1a segment 6
  CDS (1)..(90)
aggacatgggctcagcctggctatccctggcccctctacggaaacgaaggctgtggctgggccggatggctcctgtcccccagaggctcc

SEQ ID NO: 418 - protein, 30 aa, Artificial
  HepC 1a segment 6
RTWAQPGYPWPLYGNEGCGWAGWLLSPRGS

SEQ ID NO: 419 - DNA, 90 bp, Artificial
  HepC 1a segment 7
  CDS (1)..(90)
gagggatgcggatgggctggctggctgctcagccctaggggaagcagaccctcctggggacccacagaccctaggagaaggtccaggaat

SEQ ID NO: 420 - protein, 30 aa, Artificial
  HepC 1a segment 7
EGCGWAGWLLSPRGSRPSWGPTDPRRRSRN

SEQ ID NO: 421 - DNA, 90 bp, Artificial
  HepC 1a segment 8
  CDS (1)..(90)
aggcctagctggggccctaccgatcccagaaggagaagcagaaacctcggcaaagtgattgacacactgacatgcggattcgctgacctc

SEQ ID NO: 422 - protein, 30 aa, Artificial
  HepC 1a segment 8
RPSWGPTDPRRRSRNLGKVIDTLTCGFADL

SEQ ID NO: 423 - DNA, 90 bp, Artificial
  HepC 1a segment 9
  CDS (1)..(90)
ctgggaaaggtcatcgataccctcacctgtggctttgccgatctgatgggctatatccctctggtcggcgctcccctcggcggagccgct

SEQ ID NO: 424 - protein, 30 aa, Artificial
  HepC 1a segment 9
LGKVIDTLTCGFADLMGYIPLVGAPLGGAA

SEQ ID NO: 425 - DNA, 90 bp, Artificial
  HepC 1a segment 10
  CDS (1)..(90)
atgggatacattcccctcgtgggagcccctctgggaggcgctgccagagccctcgcccatggcgtcagggtcctggaagacggagtgaat

SEQ ID NO: 426 - protein, 30 aa, Artificial
  HepC 1a segment 10
MGYIPLVGAPLGGAARALAHGVRVLEDGVN

SEQ ID NO: 427 - DNA, 90 bp, Artificial
  HepC 1a segment 11
  CDS (1)..(90)
agggctctggctcacggagtgagagtgctcgaggatggcgtcaactatgccacaggcaatctgcctggctgtagctttagcattttcctc

SEQ ID NO: 428 - protein, 30 aa, Artificial
  HepC 1a segment 11
RALAHGVRVLEDGVNYATGNLPGCSFSIFL

SEQ ID NO: 429 - DNA, 90 bp, Artificial
  HepC 1a segment 12
  CDS (1)..(90)
tacgctaccggaaacctccccggatgctccttctccatctttctgctcgccctcctgtcctgcctcaccgtccccgctagcgcttaccaa

SEQ ID NO: 430 - protein, 30 aa, Artificial
  HepC 1a segment 12
YATGNLPGCSFSIFLLALLSCLTVPASAYQ

SEQ ID NO: 431 - DNA, 90 bp, Artificial
  HepC 1a segment 13
  CDS (1)..(90)
ctggctctgctcagctgtctgacagtgcctgcctccgcctatcaggtcaggaatagcacaggcctctaccatgtgacaaacgattgccct

SEQ ID NO: 432 - protein, 30 aa, Artificial
  HepC 1a segment 13
LALLSCLTVPASAYQVRNSTGLYHVTNDCP

SEQ ID NO: 433 - DNA, 90 bp, Artificial
  HepC 1a segment 14
  CDS (1)..(90)
gtgagaaactccaccggactgtatcacgtcaccaatgactgtcccaatagctccatcgtctacgaagccgctgacgctatcctccacaca

SEQ ID NO: 434 - protein, 30 aa, Artificial
  HepC 1a segment 14
VRNSTGLYHVTNDCPNSSIVYEAADAILHT

SEQ ID NO: 435 - DNA, 90 bp, Artificial
  HepC 1a segment 15
  CDS (1)..(90)
aactccagcattgtgtatgaggctgccgatgccattctgcatacccctggctgtgtgccttgcgtcagggaaggcaatgcctccaggtgt

SEQ ID NO: 436 - protein, 30 aa, Artificial
  HepC 1a segment 15
NSSIVYEAADAILHTPGCVPCVREGNASRC

SEQ ID NO: 437 - DNA, 90 bp, Artificial
  HepC 1a segment 16
  CDS (1)..(90)
cccggatgcgtcccctgtgtgagagagggaaacgctagcagatgctgggtggctatgacacccacagtggctaccagagacggaaagctc

SEQ ID NO: 438 - protein, 30 aa, Artificial
  HepC 1a segment 16
PGCVPCVREGNASRCWVAMTPTVATRDGKL

SEQ ID NO: 439 - DNA, 90 bp, Artificial
  HepC 1a segment 17
  CDS (1)..(90)
tgggtcgccatgacccctaccgtcgccacaagggatggcaaactgcctgccacacagctcaggagacacattgacctcctggtcggctcc

SEQ ID NO: 440 - protein, 30 aa, Artificial
  HepC 1a segment 17
WVAMTPTVATRDGKLPATQLRRHIDLLVGS

SEQ ID NO: 441 - DNA, 90 bp, Artificial
  HepC 1a segment 18
  CDS (1)..(90)
cccgctacccaactgagaaggcatatcgatctgctcgtgggaagcgctaccctctgctccgccctctacgtcggcgatctgtgtggctcc

SEQ ID NO: 442 - protein, 30 aa, Artificial
  HepC 1a segment 18
PATQLRRHIDLLVGSATLCSALYVGDLCGS

SEQ ID NO: 443 - DNA, 90 bp, Artificial
  HepC 1a segment 19
  CDS (1)..(90)
gccacactgtgtagcgctctgtatgtgggagacctctgcggaagcgtcttcctcgtgggacagctcttcacattctcccccagaaggcat

SEQ ID NO: 444 - protein, 30 aa, Artificial
  HepC 1a segment 19
ATLCSALYVGDLCGSVFLVGQLFTFSPRRH

SEQ ID NO: 445 - DNA, 90 bp, Artificial
  HepC 1a segment 20
  CDS (1)..(90)
gtgtttctggtcggccaactgtttacctttagccctaggagacactggaccacacagggatgcaattgctccatctatcccggacacatt

SEQ ID NO: 446 - protein, 30 aa, Artificial
  HepC 1a segment 20
VFLVGQLFTFSPRRHWTTQGCNCSIYPGHI

SEQ ID NO: 447 - DNA, 90 bp, Artificial
  HepC 1a segment 21
  CDS (1)..(90)
tggacaacccaaggctgtaactgtagcatttaccctggccatatcacaggccataggatggcctgggacatgatgatgaactggagccct

SEQ ID NO: 448 - protein, 30 aa, Artificial
  HepC 1a segment 21
WTTQGCNCSIYPGHITGHRMAWDMMMNWSP

SEQ ID NO: 449 - DNA, 90 bp, Artificial
  HepC 1a segment 22
  CDS (1)..(90)
accggacacagaatggcttgggatatgatgatgaattggtcccccacagccgctctggtcatggctcagctcctgagaatccctcaggct

SEQ ID NO: 450 - protein, 30 aa, Artificial
  HepC 1a segment 22
TGHRMAWDMMMNWSPTAALVMAQLLRIPQA

SEQ ID NO: 451 - DNA, 90 bp, Artificial; identical to SEQ ID NO: 449
  HepC 1a segment 23
  CDS (1)..(90)

SEQ ID NO: 452 - protein, 30 aa, Artificial; identical to SEQ ID NO: 450
  HepC 1a segment 23

SEQ ID NO: 453 - DNA, 90 bp, Artificial
  HepC 1a segment 24
  CDS (1)..(90)
atcctcgacatgatcgctggcgctcactggggcgtcctggctggcattgcctatttctccatggtcggcaattgggctaaggtcctggtc

SEQ ID NO: 454 - protein, 30 aa, Artificial
  HepC 1a segment 24
ILDMIAGAHWGVLAGIAYFSMVGNWAKVLV

SEQ ID NO: 455 - DNA, 90 bp, Artificial
  HepC 1a segment 25
  CDS (1)..(90)
atcgcttactttagcatggtgggaaactgggccaaagtgctcgtggtcctgctcctgtttgccggagtggatgccgaaacccatgtgaca

SEQ ID NO: 456 - protein, 30 aa, Artificial
  HepC 1a segment 25
IAYFSMVGNWAKVLVVLLLFAGVDAETHVT

SEQ ID NO: 457 - DNA, 90 bp, Artificial
  HepC 1a segment 26
  CDS (1)..(90)
gtgctcctgctcttcgctggcgtcgacgctgagacacacgtcaccggaggcaatgccggaaggacaacctccggcctcgtgtccctgctc

SEQ ID NO: 458 - protein, 30 aa, Artificial
  HepC 1a segment 26
VLLLFAGVDAETHVTGGNAGRTTSGLVSLL

SEQ ID NO: 459 - DNA, 90 bp, Artificial
  HepC 1a segment 27
  CDS (1)..(90)
ggcggaaacgctggcagaaccacaagcggactggtcagcctcctgacacccggagccaaacagaatatccaactgattaacacaaacgga

SEQ ID NO: 460 - protein, 30 aa, Artificial
  HepC 1a segment 27
GGNAGRTTSGLVSLLTPGAKQNIQLINTNG

SEQ ID NO: 461 - DNA, 90 bp, Artificial
  HepC 1a segment 28
  CDS (1)..(90)
acccctggcgctaagcaaaacattcagctcatcaataccaatggctcctggcatatcaatagcacagccctcaactgtaacgaaagcctc

SEQ ID NO: 462 - protein, 30 aa, Artificial
  HepC 1a segment 28
TPGAKQNIQLINTNGSWHINSTALNCNESL

SEQ ID NO: 463 - DNA, 90 bp, Artificial
  HepC 1a segment 29
  CDS (1)..(90)
agctggcacattaactccaccgctctgaattgcaatgagtccctgaataccggatggctcgccggactgttttaccaacacaaattcaat

SEQ ID NO: 464 - protein, 30 aa, Artificial
  HepC 1a segment 29
SWHINSTALNCNESLNTGWLAGLFYQHKFN

SEQ ID NO: 465 - DNA, 90 bp, Artificial
  HepC 1a segment 30
  CDS (1)..(90)
aacacaggctggctggctggcctcttctatcagcataagtttaactccagcggatgccctgagagactggctagctgtaggagactgaca

SEQ ID NO: 466 - protein, 30 aa, Artificial
  HepC 1a segment 30
NTGWLAGLFYQHKFNSSGCPERLASCRRLT

SEQ ID NO: 467 - DNA, 90 bp, Artificial
  HepC 1a segment 31
  CDS (1)..(90)
agctccggctgtcccgaaaggctcgcctcctgcagaaggctcaccgatttcgatcagggatggggacccattagctatgccaatggctcc

SEQ ID NO: 468 - protein, 30 aa, Artificial
  HepC 1a segment 31
SSGCPERLASCRRLTDFDQGWGPISYANGS

SEQ ID NO: 469 - DNA, 90 bp, Artificial
  HepC 1a segment 32
  CDS (1)..(90)
gactttgaccaaggctggggccctatctcctacgctaacggaagcggacccgatcagagaccctattgctggcactatccccctaagcct

SEQ ID NO: 470 - protein, 30 aa, Artificial
  HepC 1a segment 32
DFDQGWGPISYANGSGPDQRPYCWHYPPKP

SEQ ID NO: 471 - DNA, 90 bp, Artificial
  HepC 1a segment 33
  CDS (1)..(90)
ggccctgaccaaaggccttactgttggcattaccctcccaaaccctgtggcattgtgcctgccaaaagcgtctgcggacccgtctactgt

SEQ ID NO: 472 - protein, 30 aa, Artificial
  HepC 1a segment 33
GPDQRPYCWHYPPKPCGIVPAKSVCGPVYC

SEQ ID NO: 473 - DNA, 90 bp, Artificial
  HepC 1a segment 34
  CDS (1)..(90)
tgcggaatcgtccccgctaagtccgtgtgtggccctgtgtattgctttacccctagccctgtggtcgtgggaaccacagacagaagcgga

SEQ ID NO: 474 - protein, 30 aa, Artificial
  HepC 1a segment 34
CGIVPAKSVCGPVYCFTPSPVVVGTTDRSG

SEQ ID NO: 475 - DNA, 90 bp, Artificial
  HepC 1a segment 35
  CDS (1)..(90)
ttcacaccctcccccgtcgtggtcggcacaaccgataggtccggcgctcccacatactcctggggagccaatgacacagacgtcttcgtc

SEQ ID NO: 476 - protein, 30 aa, Artificial
  HepC 1a segment 35
FTPSPVVVGTTDRSGAPTYSWGANDTDVFV

SEQ ID NO: 477 - DNA, 90 bp, Artificial
  HepC 1a segment 36
  CDS (1)..(90)
gcccctacctatagctggggcgctaacgataccgatgtgtttgtgctcaacaataccagaccccctctgggaaactggttcggatgcaca

SEQ ID NO: 478 - protein, 30 aa, Artificial
  HepC 1a segment 36
APTYSWGANDTDVFVLNNTRPPLGNWFGCT

SEQ ID NO: 479 - DNA, 90 bp, Artificial
  HepC 1a segment 37
  CDS (1)..(90)
ctgaataacacaaggcctcccctcggcaattggtttggctgtacctggatgaatagcacaggctttaccaaagtgtgtggcgctccccct

SEQ ID NO: 480 - protein, 30 aa, Artificial
  HepC 1a segment 37
LNNTRPPLGNWFGCTWMNSTGFTKVCGAPP

SEQ ID NO: 481 - DNA, 90 bp, Artificial
  HepC 1a segment 38
  CDS (1)..(90)
tggatgaactccaccggattcacaaaggtctgcggagcccctccctgtgtgattggcggagccggaaacaataccctccactgtcccaca

SEQ ID NO: 482 - protein, 30 aa, Artificial
  HepC 1a segment 38
WMNSTGFTKVCGAPPCVIGGAGNNTLHCPT

SEQ ID NO: 483 - DNA, 90 bp, Artificial
  HepC 1a segment 39
  CDS (1)..(90)
tgcgtcatcggaggcgctggcaataacacactgcattgccctaccgattgctttaggaaacaccctgaggctacctatagcagatgcgga

SEQ ID NO: 484 - protein, 30 aa, Artificial
  HepC 1a segment 39
CVIGGAGNNTLHCPTDCFRKHPEATYSRCG

SEQ ID NO: 485 - DNA, 90 bp, Artificial
  HepC 1a segment 40
  CDS (1)..(90)
gactgtttcagaaagcatcccgaagccacatactccaggtgtggctccggcccttggattacccctaggtgtctggtcgactatccctat

SEQ ID NO: 486 - protein, 30 aa, Artificial
  HepC 1a segment 40
DCFRKHPEATYSRCGSGPWITPRCLVDYPY

SEQ ID NO: 487 - DNA, 90 bp, Artificial
  HepC 1a segment 41
  CDS (1)..(90)
agcggaccctggatcacacccagatgcctcgtggattacccttacagactgtggcactatccctgtaccattaactataccattttcaaa

SEQ ID NO: 488 - protein, 30 aa, Artificial
  HepC 1a segment 41
SGPWITPRCLVDYPYRLWHYPCTINYTIFK

SEQ ID NO: 489 - DNA, 90 bp, Artificial
  HepC 1a segment 42
  CDS (1)..(90)
aggctctggcattacccttgcacaatcaattacacaatctttaaggtcaggatgtacgtcggcggagtggaacacagactggaagccgct

SEQ ID NO: 490 - protein, 30 aa, Artificial
  HepC 1a segment 42
RLWHYPCTINYTIFKVRMYVGGVEHRLEAA

SEQ ID NO: 491 - DNA, 90 bp, Artificial
  HepC 1a segment 43
  CDS (1)..(90)
gtgagaatgtatgtgggaggcgtcgagcataggctcgaggctgcctgtaactggaccagaggcgaaaggtgtgacctcgaggatagggat

SEQ ID NO: 492 - protein, 30 aa, Artificial
  HepC 1a segment 43
VRMYVGGVEHRLEAACNWTRGERCDLEDRD

SEQ ID NO: 493 - DNA, 90 bp, Artificial
  HepC 1a segment 44
  CDS (1)..(90)
tgcaattggacaaggggagagagatgcgatctggaagacagagacagaagcgaactgtcccccctcctgctcagcacaacccaatggcaa

SEQ ID NO: 494 - protein, 30 aa, Artificial
  HepC 1a segment 44
CNWTRGERCDLEDRDRSELSPLLLSTTQWQ

SEQ ID NO: 495 - DNA, 90 bp, Artificial
  HepC 1a segment 45
  CDS (1)..(90)
aggtccgagctcagccctctgctcctgtccaccacacagtggcaggtcctgccttgctccttcacaaccctccccgctctgtccaccgga

SEQ ID NO: 496 - protein, 30 aa, Artificial
  HepC 1a segment 45
RSELSPLLLSTTQWQVLPCSFTTLPALSTG

SEQ ID NO: 497 - DNA, 90 bp, Artificial
  HepC 1a segment 46
  CDS (1)..(90)
gtgctcccctgtagctttaccacactgcctgccctcagcacaggcctcatccatctgcatcagaatatcgtcgacgtccagtatctgtat

SEQ ID NO: 498 - protein, 30 aa, Artificial
  HepC 1a segment 46
VLPCSFTTLPALSTGLIHLHQNIVDVQYLY

SEQ ID NO: 499 - DNA, 90 bp, Artificial
  HepC 1a segment 47
  CDS (1)..(90)
ctgattcacctccaccaaaacattgtggatgtgcaatacctctacggagtgggaagctccatcgctagctgggccattaagtgggagtat

SEQ ID NO: 500 - protein, 30 aa, Artificial
  HepC 1a segment 47
LIHLHQNIVDVQYLYGVGSSIASWAIKWEY

SEQ ID NO: 501 - DNA, 90 bp, Artificial
  HepC 1a segment 48
  CDS (1)..(90)
ggcgtcggctccagcattgcctcctgggctatcaaatgggaatacgtcgtgctcctgtttctgctcctggctgacgctagggtctgctcc

SEQ ID NO: 502 - protein, 30 aa, Artificial
  HepC 1a segment 48
GVGSSIASWAIKWEYVVLLFLLLADARVCS

SEQ ID NO: 503 - DNA, 90 bp, Artificial
  HepC 1a segment 49
  CDS (1)..(90)
gtggtcctgctcttcctcctgctcgccgatgccagagtgtgtagctgtctgtggatgatgctgctcatctcccaggctgaggctgccctc

SEQ ID NO: 504 - protein, 30 aa, Artificial
  HepC 1a segment 49
VVLLFLLLADARVCSCLWMMLLISQAEAAL

SEQ ID NO: 505 - DNA, 90 bp, Artificial
  HepC 1a segment 50
  CDS (1)..(90)
tgcctctggatgatgctcctgattagccaagccgaagccgctctggaaaacctcgtgattctgaatgccgctagcctcgccggaacccat

SEQ ID NO: 506 - protein, 30 aa, Artificial
  HepC 1a segment 50
CLWMMLLISQAEAALENLVILNAASLAGTH

SEQ ID NO: 507 - DNA, 90 bp, Artificial
  HepC 1a segment 51
  CDS (1)..(90)
gagaatctggtcatcctcaacgctgcctccctggctggcacacacggactggtcagctttctggtcttcttttgctttgcctggtacctc

SEQ ID NO: 508 - protein, 30 aa, Artificial
  HepC 1a segment 51
ENLVILNAASLAGTHGLVSFLVFFCFAWYL

SEQ ID NO: 509 - DNA, 90 bp, Artificial
  HepC 1a segment 52
  CDS (1)..(90)
ggcctcgtgtccttcctcgtgtttttctgtttcgcttggtatctgaaaggcagatgggtccccggagccgtctacgctctgtatggcatg

SEQ ID NO: 510 - protein, 30 aa, Artificial
  HepC 1a segment 52
GLVSFLVFFCFAWYLKGRWVPGAVYALYGM

SEQ ID NO: 511 - DNA, 90 bp, Artificial
  HepC 1a segment 53
  CDS (1)..(90)
aagggaaggtgggtgcctggcgctgtgtatgccctctacggaatgtggcccctcctgctcctgctcctggctctgcctcagagagcctat

SEQ ID NO: 512 - protein, 30 aa, Artificial
  HepC 1a segment 53
KGRWVPGAVYALYGMWPLLLLLLALPQRAY

SEQ ID NO: 513 - DNA, 90 bp, Artificial
  HepC 1a segment 54
  CDS (1)..(90)
tggcctctgctcctgctcctgctcgccctcccccaaagggcttacgctctggataccgaagtggctgcctcctgcggaggcgtcgtgctc

SEQ ID NO: 514 - protein, 30 aa, Artificial
  HepC 1a segment 54
WPLLLLLLALPQRAYALDTEVAASCGGVVL

SEQ ID NO: 515 - DNA, 90 bp, Artificial
  HepC 1a segment 55
  CDS (1)..(90)
gccctcgacacagaggtcgccgctagctgtggcggagtggtcctggtcggcctcatggctctgacactgtccccctattacaaaaggtat

SEQ ID NO: 516 - protein, 30 aa, Artificial
  HepC 1a segment 55
ALDTEVAASCGGVVLVGLMALTLSPYYKRY

SEQ ID NO: 517 - DNA, 90 bp, Artificial
  HepC 1a segment 56
  CDS (1)..(90)
gtgggactgatggccctcaccctcagcccttactataagagatacattagctggtgcctctggtggctgcaatactttctgacaagggtc

SEQ ID NO: 518 - protein, 30 aa, Artificial
  HepC 1a segment 56
VGLMALTLSPYYKRYISWCLWWLQYFLTRV

SEQ ID NO: 519 - DNA, 90 bp, Artificial
  HepC 1a segment 57
  CDS (1)..(90)
atctcctggtgtctgtggtggctccagtatttcctcaccagagtggaagcccaactgcatgtgtgggtgcctcccctcaacgtcagggga

SEQ ID NO: 520 - protein, 30 aa, Artificial
  HepC 1a segment 57
ISWCLWWLQYFLTRVEAQLHVWVPPLNVRG

SEQ ID NO: 521 - DNA, 90 bp, Artificial
  HepC 1a segment 58
  CDS (1)..(90)
gaggctcagctccacgtctgggtcccccctctgaatgtgagaggcggaagggatgccgtcatcctcctgatgtgcgtcgtgcatcccaca

SEQ ID NO: 522 - protein, 30 aa, Artificial
  HepC 1a segment 58
EAQLHVWVPPLNVRGGRDAVILLMCVVHPT

SEQ ID NO: 523 - DNA, 90 bp, Artificial
  HepC 1a segment 59
  CDS (1)..(90)
ggcagagacgctgtgattctgctcatgtgtgtggtccaccctaccctcgtgtttgacattaccaaactgctcctggctgtgtttggccct

SEQ ID NO: 524 - protein, 30 aa, Artificial
  HepC 1a segment 59
GRDAVILLMCVVHPTLVFDITKLLLAVFGP

SEQ ID NO: 525 - DNA, 90 bp, Artificial
  HepC 1a segment 60
  CDS (1)..(90)
ctggtcttcgatatcacaaagctcctgctcgccgtcttcggacccctctggattctgcaagcctccctgctcaaggtcccctatttcgtc

SEQ ID NO: 526 - protein, 30 aa, Artificial
  HepC 1a segment 60
LVFDITKLLLAVFGPLWILQASLLKVPYFV

SEQ ID NO: 527 - DNA, 90 bp, Artificial
  HepC 1a segment 61
  CDS (1)..(90)
ctgtggatcctccaggctagcctcctgaaagtgccttactttgtgagagtgcaaggcctcctgagaatctgtgccctcgccagaaagatg

SEQ ID NO: 528 - protein, 30 aa, Artificial
  HepC 1a segment 61
LWILQASLLKVPYFVRVQGLLRICALARKM

SEQ ID NO: 529 - DNA, 90 bp, Artificial
  HepC 1a segment 62
  CDS (1)..(90)
agggtccagggactgctcaggatttgcgctctggctaggaaaatgattggcggacactatgtgcaaatggctatcattaagctcggcgct

SEQ ID NO: 530 - protein, 30 aa, Artificial
  HepC 1a segment 62
RVQGLLRICALARKMIGGHYVQMAIIKLGA

SEQ ID NO: 531 - DNA, 90 bp, Artificial
  HepC 1a segment 63
  CDS (1)..(90)
atcggaggccattacgtccagatggccattatcaaactgggagccctcaccggaacctatgtgtataaccatctgacacccctcagggat

SEQ ID NO: 532 - protein, 30 aa, Artificial
  HepC 1a segment 63
IGGHYVQMAIIKLGALTGTYVYNHLTPLRD

SEQ ID NO: 533 - DNA, 90 bp, Artificial
  HepC 1a segment 64
  CDS (1)..(90)
ctgacaggcacatacgtctacaatcacctcacccctctgagagactgggcccataacggactgagagacctcgccgtcgccgtcgagcct

SEQ ID NO: 534 - protein, 30 aa, Artificial
  HepC 1a segment 64
LTGTYVYNHLTPLRDWAHNGLRDLAVAVEP

SEQ ID NO: 535 - DNA, 90 bp, Artificial
  HepC 1a segment 65
  CDS (1)..(90)
tgggctcacaatggcctcagggatctggctgtggctgtggaacccgtcgtgtttagccaaatggaaaccaaactgattacctggggcgct

SEQ ID NO: 536 - protein, 30 aa, Artificial
  HepC 1a segment 65
WAHNGLRDLAVAVEPVVFSQMETKLITWGA

SEQ ID NO: 537 - DNA, 90 bp, Artificial
  HepC 1a segment 66
  CDS (1)..(90)
gtggtcttctcccagatggagacaaagctcatcacatggggagccgataccgctgcctgtggcgatatcattaacggactgcctgtgtcc

SEQ ID NO: 538 - protein, 30 aa, Artificial
  HepC 1a segment 66
VVFSQMETKLITWGADTAACGDIINGLPVS

SEQ ID NO: 539 - DNA, 90 bp, Artificial
  HepC 1a segment 67
  CDS (1)..(90)
gacacagccgcttgcggagacattatcaatggcctccccgtcagcgctaggagaggcagagagattctgctcggccctgccgatggcatg

SEQ ID NO: 540 - protein, 30 aa, Artificial
  HepC 1a segment 67
DTAACGDIINGLPVSARRGREILLGPADGM

SEQ ID NO: 541 - DNA, 90 bp, Artificial
  HepC 1a segment 68
  CDS (1)..(90)
gccagaaggggaagggaaatcctcctgggacccgctgacggaatggtcagcaaaggctggaggctcctggctcccattaccgcttacgct

SEQ ID NO: 542 - protein, 30 aa, Artificial
  HepC 1a segment 68
ARRGREILLGPADGMVSKGWRLLAPITAYA

SEQ ID NO: 543 - DNA, 90 bp, Artificial
  HepC 1a segment 69
  CDS (1)..(90)
gtgtccaagggatggagactgctcgcccctatcacagcctatgcccaacagacaaggggactgctcggctgtatcattacctccctgaca

SEQ ID NO: 544 - protein, 30 aa, Artificial
  HepC 1a segment 69
VSKGWRLLAPITAYAQQTRGLLGCIITSLT

SEQ ID NO: 545 - DNA, 90 bp, Artificial
  HepC 1a segment 70
  CDS (1)..(90)
cagcaaaccagaggcctcctgggatgcattatcacaagcctcaccggaagggataagaatcaggtcgagggagaggtccagattgtgtcc

SEQ ID NO: 546 - protein, 30 aa, Artificial
  HepC 1a segment 70
QQTRGLLGCIITSLTGRDKNQVEGEVQIVS

SEQ ID NO: 547 - DNA, 90 bp, Artificial
  HepC 1a segment 71
  CDS (1)..(90)
ggcagagacaaaaaccaagtggaaggcgaagtgcaaatcgtcagcacagccgctcagacattcctcgccacatgcattaacggagtgtgt

SEQ ID NO: 548 - protein, 30 aa, Artificial
  HepC 1a segment 71
GRDKNQVEGEVQIVSTAAQTFLATCINGVC

SEQ ID NO: 549 - DNA, 90 bp, Artificial
  HepC 1a segment 72
  CDS (1)..(90)
accgctgcccaaacctttctggctacctgtatcaatggcgtctgctggaccgtctaccatggcgctggcacaaggacaatcgctagccct

SEQ ID NO: 550 - protein, 30 aa, Artificial
  HepC 1a segment 72
TAAQTFLATCINGVCWTVYHGAGTRTIASP

SEQ ID NO: 551 - DNA, 90 bp, Artificial
  HepC 1a segment 73
  CDS (1)..(90)
tggacagtgtatcacggagccggaaccagaaccattgcctcccccaaaggccctgtgattcagatgtacacaaacgtcgaccaagacctc

SEQ ID NO: 552 - protein, 30 aa, Artificial
  HepC 1a segment 73
WTVYHGAGTRTIASPKGPVIQMYTNVDQDL

SEQ ID NO: 553 - DNA, 90 bp, Artificial
  HepC 1a segment 74
  CDS (1)..(90)
aagggacccgtcatccaaatgtataccaatgtggatcaggatctggtcggctggcccgctccccaaggctccaggtccctgacaccctgt

SEQ ID NO: 554 - protein, 30 aa, Artificial
  HepC 1a segment 74
KGPVIQMYTNVDQDLVGWPAPQGSRSLTPC

SEQ ID NO: 555 - DNA, 90 bp, Artificial
  HepC 1a segment 75
  CDS (1)..(90)
gtgggatggcctgcccctcagggaagcagaagcctcaccccttgcacatgcggaagctccgacctctacctcgtgacaaggcatgccgat

SEQ ID NO: 556 - protein, 30 aa, Artificial
  HepC 1a segment 75
VGWPAPQGSRSLTPCTCGSSDLYLVTRHAD

SEQ ID NO: 557 - DNA, 90 bp, Artificial
  HepC 1a segment 76
  CDS (1)..(90)
acctgtggctccagcgatctgtatctggtcaccagacacgctgacgtcatccctgtgagaaggagaggcgatagcagaggctccctgctc

SEQ ID NO: 558 - protein, 30 aa, Artificial
  HepC 1a segment 76
TCGSSDLYLVTRHADVIPVRRRGDSRGSLL

SEQ ID NO: 559 - DNA, 90 bp, Artificial
  HepC 1a segment 77
  CDS (1)..(90)
gtgattcccgtcaggagaaggggagactccaggggaagcctcctgtcccccagacccattagctatctgaaaggctccagcggaggccct

SEQ ID NO: 560 - protein, 30 aa, Artificial
  HepC 1a segment 77
VIPVRRRGDSRGSLLSPRPISYLKGSSGGP

SEQ ID NO: 561 - DNA, 90 bp, Artificial
  HepC 1a segment 78
  CDS (1)..(90)
agccctaggcctatctcctacctcaagggaagctccggcggacccctcctgtgtcccgctggccatgccgtcggcattttcagagccgct

SEQ ID NO: 562 - protein, 30 aa, Artificial
  HepC 1a segment 78
SPRPISYLKGSSGGPLLCPAGHAVGIFRAA

SEQ ID NO: 563 - DNA, 90 bp, Artificial
  HepC 1a segment 79
  CDS (1)..(90)
ctgctctgccctgccggacacgctgtgggaatctttagggctgccgtctgcacaaggggagtggctaaggctgtggatttcattcccgtc

SEQ ID NO: 564 - protein, 30 aa, Artificial
  HepC 1a segment 79
LLCPAGHAVGIFRAAVCTRGVAKAVDFIPV

SEQ ID NO: 565 - DNA, 90 bp, Artificial
  HepC 1a segment 80
  CDS (1)..(90)
gtgtgtaccagaggcgtcgccaaagccgtcgactttatccctgtggaaaacctcgagacaaccatgaggtcccccgtcttcacagacaat

SEQ ID NO: 566 - protein, 30 aa, Artificial
  HepC 1a segment 80
VCTRGVAKAVDFIPVENLETTMRSPVFTDN

SEQ ID NO: 567 - DNA, 90 bp, Artificial
  HepC 1a segment 81
  CDS (1)..(90)
gagaatctggaaaccacaatgagaagccctgtgtttaccgataactccagccctcccgctgtgcctcagtccttccaagtggctcacctc

SEQ ID NO: 568 - protein, 30 aa, Artificial
  HepC 1a segment 81
ENLETTMRSPVFTDNSSPPAVPQSFQVAHL

SEQ ID NO: 569 - DNA, 90 bp, Artificial
  HepC 1a segment 82
  CDS (1)..(90)
agctccccccctgccgtcccccaaagctttcaggtcgcccatctgcatgcccctaccggaagcggaaagtccaccaaagtgcctgccgct

SEQ ID NO: 570 - protein, 30 aa, Artificial
  HepC 1a segment 82
SSPPAVPQSFQVAHLHAPTGSGKSTKVPAA

SEQ ID NO: 571 - DNA, 90 bp, Artificial
  HepC 1a segment 83
  CDS (1)..(90)
cacgctcccacaggctccggcaaaagcacaaaggtccccgctgcctatgccgctcagggatacaaagtgctcgtgctcaaccctagcgtc

SEQ ID NO: 572 - protein, 30 aa, Artificial
  HepC 1a segment 83
HAPTGSGKSTKVPAAYAAQGYKVLVLNPSV

SEQ ID NO: 573 - DNA, 90 bp, Artificial
  HepC 1a segment 84
  CDS (1)..(90)
tacgctgcccaaggctataaggtcctggtcctgaatccctccgtggctgccacactgggattcggagcctatatgtccaaggctcacgga

SEQ ID NO: 574 - protein, 30 aa, Artificial
  HepC 1a segment 84
YAAQGYKVLVLNPSVAATLGFGAYMSKAHG

SEQ ID NO: 575 - DNA, 90 bp, Artificial
  HepC 1a segment 85
  CDS (1)..(90)
gccgctaccctcggctttggcgcttacatgagcaaagcccatggcattgaccctaacattaggacaggcgtcaggacaatcacaaccgga

SEQ ID NO: 576 - protein, 30 aa, Artificial
  HepC 1a segment 85
AATLGFGAYMSKAHGIDPNIRTGVRTITTG

SEQ ID NO: 577 - DNA, 90 bp, Artificial
  HepC 1a segment 86
  CDS (1)..(90)
atcgatcccaatatcagaaccggagtgagaaccattaccacaggctcccccattacctatagcacatacggaaagtttctggctgacgga

SEQ ID NO: 578 - protein, 30 aa, Artificial
  HepC 1a segment 86
IDPNIRTGVRTITTGSPITYSTYGKFLADG

SEQ ID NO: 579 - DNA, 90 bp, Artificial
  HepC 1a segment 87
  CDS (1)..(90)
agccctatcacatactccacctatggcaaattcctcgccgatggcggatgctccggcggagcctatgacattatcatttgcgatgagtgt

SEQ ID NO: 580 - protein, 30 aa, Artificial
  HepC 1a segment 87
SPITYSTYGKFLADGGCSGGAYDIIICDEC

SEQ ID NO: 581 - DNA, 90 bp, Artificial
  HepC 1a segment 88
  CDS (1)..(90)
ggctgtagcggaggcgcttacgatatcattatctgtgacgaatgccatagcacagacgctacctccatcctcggcattggcacagtgctc

SEQ ID NO: 582 - protein, 30 aa, Artificial
  HepC 1a segment 88
GCSGGAYDIIICDECHSTDATSILGIGTVL

SEQ ID NO: 583 - DNA, 90 bp, Artificial
  HepC 1a segment 89
  CDS (1)..(90)
cactccaccgatgccacaagcattctgggaatcggaaccgtcctggatcaggctgagacagccggagccagactggtcgtgctcgccaca

SEQ ID NO: 584 - protein, 30 aa, Artificial
  HepC 1a segment 89
HSTDATSILGIGTVLDQAETAGARLVVLAT

SEQ ID NO: 585 - DNA, 90 bp, Artificial
  HepC 1a segment 90
  CDS (1)..(90)
gaccaagccgaaaccgctggcgctaggctcgtggtcctggctaccgctacccctcccggaagcgtcaccgtcccccatcccaatatcgaa

SEQ ID NO: 586 - protein, 30 aa, Artificial
  HepC 1a segment 90
DQAETAGARLVVLATATPPGSVTVPHPNIE

SEQ ID NO: 587 - DNA, 90 bp, Artificial
  HepC 1a segment 91
  CDS (1)..(90)
gccacaccccctggctccgtgacagtgcctcaccctaacattgaggaagtggctctgtccaccacaggcgaaatccctttctatggcaaa

SEQ ID NO: 588 - protein, 30 aa, Artificial
  HepC 1a segment 91
ATPPGSVTVPHPNIEEVALSTTGEIPFYGK

SEQ ID NO: 589 - DNA, 90 bp, Artificial
  HepC 1a segment 92
  CDS (1)..(90)
gaggtcgccctcagcacaaccggagagattcccttttacggaaaggctatccctctggaagtgattaagggaggcagacacctcatcttt

SEQ ID NO: 590 - protein, 30 aa, Artificial
  HepC 1a segment 92
EVALSTTGEIPFYGKAIPLEVIKGGRHLIF

SEQ ID NO: 591 - DNA, 90 bp, Artificial
  HepC 1a segment 93
  CDS (1)..(90)
gccattcccctcgaggtcatcaaaggcggaaggcatctgattttctgtcactccaagaaaaagtgtgacgaactggctgccaaactggtc

SEQ ID NO: 592 - protein, 30 aa, Artificial
  HepC 1a segment 93
AIPLEVIKGGRHLIFCHSKKKCDELAAKLV

SEQ ID NO: 593 - DNA, 90 bp, Artificial
  HepC 1a segment 94
  CDS (1)..(90)
tgccatagcaaaaagaaatgcgatgagctcgccgctaagctcgtggctctgggaatcaatgccgtcgcctattacagaggcctcgacgtc

SEQ ID NO: 594 - protein, 30 aa, Artificial
  HepC 1a segment 94
CHSKKKCDELAAKLVALGINAVAYYRGLDV

SEQ ID NO: 595 - DNA, 90 bp, Artificial
  HepC 1a segment 95
  CDS (1)..(90)
gccctcggcattaacgctgtggcttactataggggactggatgtgtccgtgattcccacaagcggagacgtcgtggtcgtggctaccgat

SEQ ID NO: 596 - protein, 30 aa, Artificial
  HepC 1a segment 95
ALGINAVAYYRGLDVSVIPTSGDVVVVATD

SEQ ID NO: 597 - DNA, 90 bp, Artificial
  HepC 1a segment 96
  CDS (1)..(90)
agcgtcatccctacctccggcgatgtggtcgtggtcgccacagacgctctgatgaccggatacacaggcgatttcgatagcgtcatcgat

SEQ ID NO: 598 - protein, 30 aa, Artificial
  HepC 1a segment 96
SVIPTSGDVVVVATDALMTGYTGDFDSVID

SEQ ID NO: 599 - DNA, 90 bp, Artificial
  HepC 1a segment 97
  CDS (1)..(90)
gccctcatgacaggctataccggagactttgactccgtgattgactgtaacacatgcgtcacccaaaccgtcgactttagcctcgaccct

SEQ ID NO: 600 - protein, 30 aa, Artificial
  HepC 1a segment 97
ALMTGYTGDFDSVIDCNTCVTQTVDFSLDP

SEQ ID NO: 601 - DNA, 90 bp, Artificial
  HepC 1a segment 98
  CDS (1)..(90)
tgcaatacctgtgtgacacagacagtggatttctccctggatcccacattcacaatcgaaaccacaaccctcccccaagacgctgtgtcc

SEQ ID NO: 602 - protein, 30 aa, Artificial
  HepC 1a segment 98
CNTCVTQTVDFSLDPTFTIETTTLPQDAVS

SEQ ID NO: 603 - DNA, 90 bp, Artificial
  HepC 1a segment 99
  CDS (1)..(90)
acctttaccattgagacaaccacactgcctcaggatgccgtcagcagaacccaaaggagaggcagaaccggaaggggaaagcctggcatt

SEQ ID NO: 604 - protein, 30 aa, Artificial
  HepC 1a segment 99
TFTIETTTLPQDAVSRTQRRGRTGRGKPGI

SEQ ID NO: 605 - DNA, 90 bp, Artificial
  HepC 1a segment 100
  CDS (1)..(90)
aggacacagagaaggggaaggacaggcagaggcaaacccggaatctataggtttgtggctcccggagagagaccctccggcatgttcgat

SEQ ID NO: 606 - protein, 30 aa, Artificial
  HepC 1a segment 100
RTQRRGRTGRGKPGIYRFVAPGERPSGMFD

SEQ ID NO: 607 - DNA, 90 bp, Artificial
  HepC 1a segment 101
  CDS (1)..(90)
tacagattcgtcgcccctggcgaaaggcctagcggaatgtttgactccagcgtcctgtgtgagtgttacgatgccggatgcgcttggtat

SEQ ID NO: 608 - protein, 30 aa, Artificial
  HepC 1a segment 101
YRFVAPGERPSGMFDSSVLCECYDAGCAWY

SEQ ID NO: 609 - DNA, 90 bp, Artificial
  HepC 1a segment 102
  CDS (1)..(90)
agctccgtgctctgcgaatgctatgacgctggctgtgcctggtacgaactgacacccgctgagacaaccgtcaggctcagggcttacatg

SEQ ID NO: 610 - protein, 30 aa, Artificial
  HepC 1a segment 102
SSVLCECYDAGCAWYELTPAETTVRLRAYM

SEQ ID NO: 611 - DNA, 90 bp, Artificial
  HepC 1a segment 103
  CDS (1)..(90)
gagctcacccctgccgaaaccacagtgagactgagagcctatatgaatacccctggcctccccgtctgccaagaccatctggaattctgg

SEQ ID NO: 612 - protein, 30 aa, Artificial
  HepC 1a segment 103
ELTPAETTVRLRAYMNTPGLPVCQDHLEFW

SEQ ID NO: 613 - DNA, 90 bp, Artificial
  HepC 1a segment 104
  CDS (1)..(90)
aacacacccggactgcctgtgtgtcaggatcacctcgagttttgggaaggcgtcttcacaggcctcacccatatcgatgcccatttcctc

SEQ ID NO: 614 - protein, 30 aa, Artificial
  HepC 1a segment 104
NTPGLPVCQDHLEFWEGVFTGLTHIDAHFL

SEQ ID NO: 615 - DNA, 90 bp, Artificial
  HepC 1a segment 105
  CDS (1)..(90)
gagggagtgtttaccggactgacacacattgacgctcactttctgtcccagacaaagcaaagcggagagaatttcccttacctcgtggct

SEQ ID NO: 616 - protein, 30 aa, Artificial
  HepC 1a segment 105
EGVFTGLTHIDAHFLSQTKQSGENFPYLVA

SEQ ID NO: 617 - DNA, 90 bp, Artificial
  HepC 1a segment 106
  CDS (1)..(90)
agccaaaccaaacagtccggcgaaaactttccctatctggtcgcctatcaggctaccgtctgcgctagggctcaggctccccctccctcc

SEQ ID NO: 618 - protein, 30 aa, Artificial
  HepC 1a segment 106
SQTKQSGENFPYLVAYQATVCARAQAPPPS

SEQ ID NO: 619 - DNA, 90 bp, Artificial
  HepC 1a segment 107
  CDS (1)..(90)
taccaagccacagtgtgtgccagagcccaagcccctccccctagctgggaccaaatgtggaagtgtctgattaggctcaagcctaccctc

SEQ ID NO: 620 - protein, 30 aa, Artificial
  HepC 1a segment 107
YQATVCARAQAPPPSWDQMWKCLIRLKPTL

SEQ ID NO: 621 - DNA, 90 bp, Artificial
  HepC 1a segment 108
  CDS (1)..(90)
tgggatcagatgtggaaatgcctcatcagactgaaacccacactgcatggccctacccctctgctctacagactgggagccgtccagaat

SEQ ID NO: 622 - protein, 30 aa, Artificial
  HepC 1a segment 108
WDQMWKCLIRLKPTLHGPTPLLYRLGAVQN

SEQ ID NO: 623 - DNA, 90 bp, Artificial
  HepC 1a segment 109
  CDS (1)..(90)
cacggacccacacccctcctgtataggctcggcgctgtgcaaaacgaagtgacactgacacaccctgtgacaaagtatatcatgacctgt

SEQ ID NO: 624 - protein, 30 aa, Artificial
  HepC 1a segment 109
HGPTPLLYRLGAVQNEVTLTHPVTKYIMTC

SEQ ID NO: 625 - DNA, 90 bp, Artificial
  HepC 1a segment 110
  CDS (1)..(90)
gaggtcaccctcacccatcccgtcaccaaatacattatgacatgcatgagcgctgacctcgaggtcgtgacaagcacatgggtcctggtc

SEQ ID NO: 626 - protein, 30 aa, Artificial
  HepC 1a segment 110
EVTLTHPVTKYIMTCMSADLEVVTSTWVLV

SEQ ID NO: 627 - DNA, 90 bp, Artificial
  HepC 1a segment 111
  CDS (1)..(90)
atgtccgccgatctggaagtggtcacctccacctgggtgctcgtgggaggcgtcctggctgccctcgccgcttactgtctgtccaccgga

SEQ ID NO: 628 - protein, 30 aa, Artificial
  HepC 1a segment 111
MSADLEVVTSTWVLVGGVLAALAAYCLSTG

SEQ ID NO: 629 - DNA, 90 bp, Artificial
  HepC 1a segment 112
  CDS (1)..(90)
ggcggagtgctcgccgctctggctgcctattgcctcagcacaggctgtgtggtcatcgtcggcagaatcgtcctgtccggcaaacccgct

SEQ ID NO: 630 - protein, 30 aa, Artificial
  HepC 1a segment 112
GGVLAALAAYCLSTGCVVIVGRIVLSGKPA

SEQ ID NO: 631 - DNA, 90 bp, Artificial
  HepC 1a segment 114
  CDS (1)..(90)
tgcgtcgtgattgtgggaaggattgtgctcagcggaaagcctgccattatccctgacagagaggtcctgtatagggaattcgatgagatg

SEQ ID NO: 632 - protein, 30 aa, Artificial
  HepC 1a segment 114
CVVIVGRIVLSGKPAIIPDREVLYREFDEM

SEQ ID NO: 633 - DNA, 90 bp, Artificial
  HepC 1a segment 115
  CDS (1)..(90)
atcattcccgatagggaagtgctctacagagagtttgacgaaatggaagagtgtagccaacacctcccctatatcgaacagggaatgatg

SEQ ID NO: 634 - protein, 30 aa, Artificial
  HepC 1a segment 115
IIPDREVLYREFDEMEECSQHLPYIEQGMM

SEQ ID NO: 635 - DNA, 90 bp, Artificial
  HepC 1a segment 116
  CDS (1)..(90)
gaggaatgctcccagcatctgccttacattgagcaaggcatgatgctcgccgaacagtttaagcaaaaggctctgggactgctccagaca

SEQ ID NO: 636 - protein, 30 aa, Artificial
  HepC 1a segment 116
EECSQHLPYIEQGMMLAEQFKQKALGLLQT

SEQ ID NO: 637 - DNA, 90 bp, Artificial
  HepC 1a segment 117
  CDS (1)..(90)
ctggctgagcaattcaaacagaaagccctcggcctcctgcaaaccgctagcagacaggctgaggtcatcgctcccgctgtgcaaaccaat

SEQ ID NO: 638 - protein, 30 aa, Artificial
  HepC 1a segment 117
LAEQFKQKALGLLQTASRQAEVIAPAVQTN

SEQ ID NO: 639 - DNA, 90 bp, Artificial
  HepC 1a segment 117
  CDS (1)..(90)
gcctccaggcaagccgaagtgattgcccctgccgtccagacaaactggcagaaactggaagtgttttgggctaagcatatgtggaacttt

SEQ ID NO: 640 - protein, 30 aa, Artificial
  HepC 1a segment 117
ASRQAEVIAPAVQTNWQKLEVFWAKHMWNF

SEQ ID NO: 641 - DNA, 90 bp, Artificial
  HepC 1a segment 118
  CDS (1)..(90)
tggcaaaagctcgaggtcttctgggccaaacacatgtggaatttcattagcggaatccaatacctcgccggactgtccaccctccccgga

SEQ ID NO: 642 - protein, 30 aa, Artificial
  HepC 1a segment 118
WQKLEVFWAKHMWNFISGIQYLAGLSTLPG

SEQ ID NO: 643 - DNA, 90 bp, Artificial
  HepC 1a segment 119
  CDS (1)..(90)
atctccggcattcagtatctggctggcctcagcacactgcctggcaatcccgctatcgctagcctcatggctttcacagccgctgtgaca

SEQ ID NO: 644 - protein, 30 aa, Artificial
  HepC 1a segment 119
ISGIQYLAGLSTLPGNPAIASLMAFTAAVT

SEQ ID NO: 645 - DNA, 90 bp, Artificial
  HepC 1a segment 120
  CDS (1)..(90)
aaccctgccattgcctccctgatggcctttaccgctgccgtcacctcccccctcaccacaagccaaaccctcctgtttaacattctggga

SEQ ID NO: 646 - protein, 30 aa, Artificial
  HepC 1a segment 120
NPAIASLMAFTAAVTSPLTTSQTLLFNILG

SEQ ID NO: 647 - DNA, 90 bp, Artificial
  HepC 1a segment 121
  CDS (1)..(90)
agccctctgacaacctcccagacactgctcttcaatatcctcggcggatgggtcgccgctcagctcgccgctcccggagccgctaccgct

SEQ ID NO: 648 - protein, 30 aa, Artificial
  HepC 1a segment 121
SPLTTSQTLLFNILGGWVAAQLAAPGAATA

SEQ ID NO: 649 - DNA, 90 bp, Artificial
  HepC 1a segment 122
  CDS (1)..(90)
ggctgggtggctgcccaactggctgcccctggcgctgccacagcctttgtgggagccggactggctggcgctgccattggctccgtggga

SEQ ID NO: 650 - protein, 30 aa, Artificial
  HepC 1a segment 122
GWVAAQLAAPGAATAFVGAGLAGAAIGSVG

SEQ ID NO: 651 - DNA, 90 bp, Artificial
  HepC 1a segment 123
  CDS (1)..(90)
ttcgtcggcgctggcctcgccggagccgctatcggaagcgtcggcctcggcaaagtgctcgtggatatcctcgccggatacggagccgga

SEQ ID NO: 652 - protein, 30 aa, Artificial
  HepC 1a segment 123
FVGAGLAGAAIGSVGLGKVLVDILAGYGAG

SEQ ID NO: 653 - DNA, 90 bp, Artificial
  HepC 1a segment 124
  CDS (1)..(90)
ctgggaaaggtcctggtcgacattctggctggctatggcgctggcgtcgccggagccctcgtggctttcaaaatcatgagcggagaggtc

SEQ ID NO: 654 - protein, 30 aa, Artificial
  HepC 1a segment 124
LGKVLVDILAGYGAGVAGALVAFKIMSGEV

SEQ ID NO: 655 - DNA, 90 bp, Artificial
  HepC 1a segment 125
  CDS (1)..(90)
gtggctggcgctctggtcgcctttaagattatgtccggcgaagtgcctagcacagaggatctggtcaacctcctgcctgccattctgtcc

SEQ ID NO: 656 - protein, 30 aa, Artificial
  HepC 1a segment 125
VAGALVAFKIMSGEVPSTEDLVNLLPAILS

SEQ ID NO: 657 - DNA, 90 bp, Artificial
  HepC 1a segment 126
  CDS (1)..(90)
ccctccaccgaagacctcgtgaatctgctccccgctatcctcagccctggcgctctggtcgtgggagtggtctgcgctgccattctgaga

SEQ ID NO: 658 - protein, 30 aa, Artificial
  HepC 1a segment 126
PSTEDLVNLLPAILSPGALVVGVVCAAILR

SEQ ID NO: 659 - DNA, 90 bp, Artificial
  HepC 1a segment 127
  CDS (1)..(90)
cccggagccctcgtggtcggcgtcgtgtgtgccgctatcctcaggagacacgtcggccctggcgaaggcgctgtgcaatggatgaacaga

SEQ ID NO: 660 - protein, 30 aa, Artificial
  HepC 1a segment 127
PGALVVGVVCAAILRRHVGPGEGAVQWMNR

SEQ ID NO: 661 - DNA, 90 bp, Artificial
  HepC 1a segment 128
  CDS (1)..(90)
aggcatgtgggacccggagagggagccgtccagtggatgaataggctcatcgctttcgctagcagaggcaatcacgtcagccctacccat

SEQ ID NO: 662 - protein, 30 aa, Artificial
  HepC 1a segment 128
RHVGPGEGAVQWMNRLIAFASRGNHVSPTH

SEQ ID NO: 663 - DNA, 90 bp, Artificial
  HepC 1a segment 129
  CDS (1)..(90)
ctgattgcctttgcctccaggggaaaccatgtgtcccccacacactatgtgcctgagtccgacgctgccgctagggtcaccgctatcctc

SEQ ID NO: 664 - protein, 30 aa, Artificial
  HepC 1a segment 129
LIAFASRGNHVSPTHYVPESDAAARVTAIL

SEQ ID NO: 665 - DNA, 90 bp, Artificial
  HepC 1a segment 130
  CDS (1)..(90)
tacgtccccgaaagcgatgccgctgccagagtgacagccattctgtccagcctcaccgtcacccaactgctcaggagactgcatcagtgg

SEQ ID NO: 666 - protein, 30 aa, Artificial
  HepC 1a segment 130
YVPESDAAARVTAILSSLTVTQLLRRLHQW

SEQ ID NO: 667 - DNA, 90 bp, Artificial
  HepC 1a segment 131
  CDS (1)..(90)
agctccctgacagtgacacagctcctgagaaggctccaccaatggattagctccgagtgtaccacaccctgtagcggaagctggctgaga

SEQ ID NO: 668 - protein, 30 aa, Artificial
  HepC 1a segment 131
SSLTVTQLLRRLHQWISSECTTPCSGSWLR

SEQ ID NO: 669 - DNA, 90 bp, Artificial
  HepC 1a segment 132
  CDS (1)..(90)
atctccagcgaatgcacaaccccttgctccggctcctggctcagggatatctgggactggatctgtgaggtcctgtccgactttaagaca

SEQ ID NO: 670 - protein, 30 aa, Artificial
  HepC 1a segment 132
ISSECTTPCSGSWLRDIWDWICEVLSDFKT

SEQ ID NO: 671 - DNA, 90 bp, Artificial
  HepC 1a segment 133
  CDS (1)..(90)
gacatttgggattggatttgcgaagtgctcagcgatttcaaaacctggctgaaagccaaactgatgccccaactgcctggcattcccttt

SEQ ID NO: 672 - protein, 30 aa, Artificial
  HepC 1a segment 133
DIWDWICEVLSDFKTWLKAKLMPQLPGIPF

SEQ ID NO: 673 - DNA, 90 bp, Artificial
  HepC 1a segment 134
  CDS (1)..(90)
tggctcaaggctaagctcatgcctcagctccccggaatccctttcgtcagctgtcagagaggctataagggagtgtggaggggagacgga

SEQ ID NO: 674 - protein, 30 aa, Artificial
  HepC 1a segment 134
WLKAKLMPQLPGIPFVSCQRGYKGVWRGDG

SEQ ID NO: 675 - DNA, 90 bp, Artificial
  HepC 1a segment 135
  CDS (1)..(90)
gtgtcctgccaaaggggatacaaaggcgtctggagaggcgatggcattatgcataccagatgccattgcggagccgaaatcacaggccat

SEQ ID NO: 676 - protein, 30 aa, Artificial
  HepC 1a segment 135
VSCQRGYKGVWRGDGIMHTRCHCGAEITGH

SEQ ID NO: 677 - DNA, 90 bp, Artificial
  HepC 1a segment 136
  CDS (1)..(90)
atcatgcacacaaggtgtcactgtggcgctgagattaccggacacgtcaagaatggcacaatgagaatcgtcggccctaggacatgcaga

SEQ ID NO: 678 - protein, 30 aa, Artificial
  HepC 1a segment 136
IMHTRCHCGAEITGHVKNGTMRIVGPRTCR

SEQ ID NO: 679 - DNA, 90 bp, Artificial
  HepC 1a segment 137
  CDS (1)..(90)
gtgaaaaacggaaccatgaggattgtgggacccagaacctgtaggaatatgtggagcggaacctttcccattaacgcttacacaaccgga

SEQ ID NO: 680 - protein, 30 aa, Artificial
  HepC 1a segment 137
VKNGTMRIVGPRTCRNMWSGTFPINAYTTG

SEQ ID NO: 681 - DNA, 90 bp, Artificial
  HepC 1a segment 138
  CDS (1)..(90)
aacatgtggtccggcacattccctatcaatgcctataccacaggcccttgcacacccctccccgctcccaattacacattcgctctgtgg

SEQ ID NO: 682 - protein, 30 aa, Artificial
  HepC 1a segment 138
NMWSGTFPINAYTTGPCTPLPAPNYTFALW

SEQ ID NO: 683 - DNA, 90 bp, Artificial
  HepC 1a segment 139
  CDS (1)..(90)
ccctgtacccctctgcctgcccctaactatacctttgccctctggagagtgtccgccgaagagtatgtggaaatcagaagggtcggcgat

SEQ ID NO: 684 - protein, 30 aa, Artificial
  HepC 1a segment 139
PCTPLPAPNYTFALWRVSAEEYVEIRRVGD

SEQ ID NO: 685 - DNA, 90 bp, Artificial
  HepC 1a segment 140
  CDS (1)..(90)
agggtcagcgctgaggaatacgtcgagattaggagagtgggagactttcactatgtgacaggcatgaccacagacaatctgaaatgccct

SEQ ID NO: 686 - protein, 30 aa, Artificial
  HepC 1a segment 140
RVSAEEYVEIRRVGDFHYVTGMTTDNLKCP

SEQ ID NO: 687 - DNA, 90 bp, Artificial
  HepC 1a segment 141
  CDS (1)..(90)
ttccattacgtcaccggaatgacaaccgataacctcaagtgtccctgtcaggtcccctcccccgaattctttaccgaactggatggcgtc

SEQ ID NO: 688 - protein, 30 aa, Artificial
  HepC 1a segment 141
FHYVTGMTTDNLKCPCQVPSPEFFTELDGV

SEQ ID NO: 689 - DNA, 90 bp, Artificial
  HepC 1a segment 142
  CDS (1)..(90)
tgccaagtgcctagccctgagtttttcacagagctcgacggagtgagactgcataggtttgcccctccctgtaagcctctgctcagggaa

SEQ ID NO: 690 - protein, 30 aa, Artificial
  HepC 1a segment 142
CQVPSPEFFTELDGVRLHRFAPPCKPLLRE

SEQ ID NO: 691 - DNA, 90 bp, Artificial
  HepC 1a segment 143
  CDS (1)..(90)
aggctccacagattcgctcccccttgcaaacccctcctgagagaggaagtgtccttcagagtgggactgcatgagtatcccgtcggctcc

SEQ ID NO: 692 - protein, 30 aa, Artificial
  HepC 1a segment 143
RLHRFAPPCKPLLREEVSFRVGLHEYPVGS

SEQ ID NO: 693 - DNA, 90 bp, Artificial
  HepC 1a segment 144
  CDS (1)..(90)
gaggtcagctttagggtcggcctccacgaataccctgtgggaagccaactgccttgcgaacccgaacccgatgtggctgtgctcacctcc

SEQ ID NO: 694 - protein, 30 aa, Artificial
  HepC 1a segment 144
EVSFRVGLHEYPVGSQLPCEPEPDVAVLTS

SEQ ID NO: 695 - DNA, 90 bp, Artificial
  HepC 1a segment 145
  CDS (1)..(90)
cagctcccctgtgagcctgagcctgacgtcgccgtcctgacaagcatgctgacagaccctagccatatcacagccgaagccgctggcaga

SEQ ID NO: 696 - protein, 30 aa, Artificial
  HepC 1a segment 145
QLPCEPEPDVAVLTSMLTDPSHITAEAAGR

SEQ ID NO: 697 - DNA, 90 bp, Artificial
  HepC 1a segment 146
  CDS (1)..(90)
atgctcaccgatccctcccacattaccgctgaggctgccggaaggagactggctaggggaagccctccctccatggctagctccagcgct

SEQ ID NO: 698 - protein, 30 aa, Artificial
  HepC 1a segment 146
MLTDPSHITAEAAGRRLARGSPPSMASSSA

SEQ ID NO: 699 - DNA, 90 bp, Artificial
  HepC 1a segment 147
  CDS (1)..(90)
aggctcgccagaggctccccccctagcatggcctccagctccgcctcccagctcagcgctccctccctgaaagccacatgcacagccaat

SEQ ID NO: 700 - protein, 30 aa, Artificial
  HepC 1a segment 147
RLARGSPPSMASSSASQLSAPSLKATCTAN

SEQ ID NO: 701 - DNA, 90 bp, Artificial
  HepC 1a segment 148
  CDS (1)..(90)
agccaactgtccgcccctagcctcaaggctacctgtaccgctaaccatgactcccccgatgccgaactgattgaggctaacctcctgtgg

SEQ ID NO: 702 - protein, 30 aa, Artificial
  HepC 1a segment 148
SQLSAPSLKATCTANHDSPDAELIEANLLW

SEQ ID NO: 703 - DNA, 90 bp, Artificial
  HepC 1a segment 149
  CDS (1)..(90)
cacgatagccctgacgctgagctcatcgaagccaatctgctctggagacaggaaatgggaggcaatatcacaagggtcgagtccgagaat

SEQ ID NO: 704 - protein, 30 aa, Artificial
  HepC 1a segment 149
HDSPDAELIEANLLWRQEMGGNITRVESEN

SEQ ID NO: 705 - DNA, 90 bp, Artificial
  HepC 1a segment 150
  CDS (1)..(90)
aggcaagagatgggcggaaacattaccagagtggaaagcgaaaacaaagtggtcatcctcgactccttcgatcccctcgtggctgaggaa

SEQ ID NO: 706 - protein, 30 aa, Artificial
  HepC 1a segment 150
RQEMGGNITRVESENKVVILDSFDPLVAEE

SEQ ID NO: 707 - DNA, 90 bp, Artificial
  HepC 1a segment 151
  CDS (1)..(90)
aaggtcgtgattctggatagctttgaccctctggtcgccgaagaggatgagagagagattagcgtccccgctgagattctgagaaagtcc

SEQ ID NO: 708 - protein, 30 aa, Artificial
  HepC 1a segment 151
KVVILDSFDPLVAEEDEREISVPAEILRKS

SEQ ID NO: 709 - DNA, 90 bp, Artificial
  HepC 1a segment 152
  CDS (1)..(90)
gacgaaagggaaatctccgtgcctgccgaaatcctcaggaaaagcagaaggtttgcccaagccctccccgtctgggctaggcctgactat

SEQ ID NO: 710 - protein, 30 aa, Artificial
  HepC 1a segment 152
DEREISVPAEILRKSRRFAQALPVWARPDY

SEQ ID NO: 711 - DNA, 90 bp, Artificial
  HepC 1a segment 153
  CDS (1)..(90)
aggagattcgctcaggctctgcctgtgtgggccagacccgattacaatccccctctggtcgagacatggaaaaagcctgactatgagcct

SEQ ID NO: 712 - protein, 30 aa, Artificial
  HepC 1a segment 153
RRFAQALPVWARPDYNPPLVETWKKPDYEP

SEQ ID NO: 713 - DNA, 90 bp, Artificial
  HepC 1a segment 154
  CDS (1)..(90)
aaccctcccctcgtggaaacctggaagaaacccgattacgaaccccctgtggtccacggatgccctctgcctccccctaggtccccccct

SEQ ID NO: 714 - protein, 30 aa, Artificial
  HepC 1a segment 154
NPPLVETWKKPDYEPPVVHGCPLPPPRSPP

SEQ ID NO: 715 - DNA, 90 bp, Artificial
  HepC 1a segment 155
  CDS (1)..(90)
cccgtcgtgcatggctgtcccctcccccctcccagaagccctcccgtcccccctcccagaaagaaaaggacagtggtcctgacagagtcc

SEQ ID NO: 716 - protein, 30 aa, Artificial
  HepC 1a segment 155
PVVHGCPLPPPRSPPVPPPRKKRTVVLTES

SEQ ID NO: 717 - DNA, 90 bp, Artificial
  HepC 1a segment 156
  CDS (1)..(90)
gtgcctccccctaggaaaaagagaaccgtcgtgctcaccgaaagcacactgtccaccgctctggctgagctcgccacaaagtccttcgga

SEQ ID NO: 718 - protein, 30 aa, Artificial
  HepC 1a segment 156
VPPPRKKRTVVLTESTLSTALAELATKSFG

SEQ ID NO: 719 - DNA, 90 bp, Artificial
  HepC 1a segment 157
  CDS (1)..(90)
accctcagcacagccctcgccgaactggctaccaaaagctttggctccagctccacctccggcattaccggagacaataccacaacctcc

SEQ ID NO: 720 - protein, 30 aa, Artificial
  HepC 1a segment 157
TLSTALAELATKSFGSSSTSGITGDNTTTS

SEQ ID NO: 721 - DNA, 90 bp, Artificial
  HepC 1a segment 158
  CDS (1)..(90)
agctccagcacaagcggaatcacaggcgataacacaaccacaagctccgagcctgcccctagcggatgccctcccgatagcgatgccgaa

SEQ ID NO: 722 - protein, 30 aa, Artificial
  HepC 1a segment 158
SSSTSGITGDNTTTSSEPAPSGCPPDSDAE

SEQ ID NO: 723 - DNA, 90 bp, Artificial
  HepC 1a segment 159
  CDS (1)..(90)
agcgaacccgctccctccggctgtccccctgactccgacgctgagtcctactccagcatgccccctctggaaggcgaacccggagaccct

SEQ ID NO: 724 - protein, 30 aa, Artificial
  HepC 1a segment 159
SEPAPSGCPPDSDAESYSSMPPLEGEPGDP

SEQ ID NO: 725 - DNA, 90 bp, Artificial
  HepC 1a segment 160
  CDS (1)..(90)
agctatagctccatgcctcccctcgagggagagcctggcgatcccgatctgtccgacggaagctggagcacagtgtccagcgaagccgga

SEQ ID NO: 726 - protein, 30 aa, Artificial
  HepC 1a segment 160
SYSSMPPLEGEPGDPDLSDGSWSTVSSEAG

SEQ ID NO: 727 - DNA, 90 bp, Artificial
  HepC 1a segment 161
  CDS (1)..(90)
gacctcagcgatggctcctggtccaccgtcagctccgaggctggcacagaggatgtggtctgctgtagcatgagctatagctggaccgga

SEQ ID NO: 728 - protein, 30 aa, Artificial
  HepC 1a segment 161
DLSDGSWSTVSSEAGTEDVVCCSMSYSWTG

SEQ ID NO: 729 - DNA, 90 bp, Artificial
  HepC 1a segment 162
  CDS (1)..(90)
accgaagacgtcgtgtgttgctccatgtcctactcctggacaggcgctctggtcaccccttgcgctgccgaagagcaaaagctccccatt

SEQ ID NO: 730 - protein, 30 aa, Artificial
  HepC 1a segment 162
TEDVVCCSMSYSWTGALVTPCAAEEQKLPI

SEQ ID NO: 731 - DNA, 90 bp, Artificial
  HepC 1a segment 163
  CDS (1)..(90)
gccctcgtgacaccctgtgccgctgaggaacagaaactgcctatcaatgccctcagcaatagcctcctgagacaccataacctcgtgtat

SEQ ID NO: 732 - protein, 30 aa, Artificial
  HepC 1a segment 163
ALVTPCAAEEQKLPINALSNSLLRHHNLVY

SEQ ID NO: 733 - DNA, 90 bp, Artificial
  HepC 1a segment 164
  CDS (1)..(90)
aacgctctgtccaactccctgctcaggcatcacaatctggtctactccaccacaagcagaagcgcttgccaaaggcaaaagaaagtgaca

SEQ ID NO: 734 - protein, 30 aa, Artificial
  HepC 1a segment 164
NALSNSLLRHHNLVYSTTSRSACQRQKKVT

SEQ ID NO: 735 - DNA, 90 bp, Artificial
  HepC 1a segment 165
  CDS (1)..(90)
agcacaacctccaggtccgcctgtcagagacagaaaaaggtcacctttgacagactgcaagtgctcgactcccactatcaggatgtgctc

SEQ ID NO: 736 - protein, 30 aa, Artificial
  HepC 1a segment 165
STTSRSACQRQKKVTFDRLQVLDSHYQDVL

SEQ ID NO: 737 - DNA, 90 bp, Artificial
  HepC 1a segment 166
  CDS (1)..(90)
ttcgataggctccaggtcctggatagccattaccaagacgtcctgaaagaggtcaaggctgccgctagcaaagtgaaagccaatctgctc

SEQ ID NO: 738 - protein, 30 aa, Artificial
  HepC 1a segment 166
FDRLQVLDSHYQDVLKEVKAAASKVKANLL

SEQ ID NO: 739 - DNA, 90 bp, Artificial
  HepC 1a segment 167
  CDS (1)..(90)
aaggaagtgaaagccgctgcctccaaggtcaaggctaacctcctgtccgtggaagaggcttgctccctgacaccccctcactccgccaaa

SEQ ID NO: 740 - protein, 30 aa, Artificial
  HepC 1a segment 167
KEVKAAASKVKANLLSVEEACSLTPPHSAK

SEQ ID NO: 741 - DNA, 90 bp, Artificial
  HepC 1a segment 168
  CDS (1)..(90)
agcgtcgaggaagcctgtagcctcacccctccccatagcgctaagtccaagtttggctatggcgctaaggatgtgagatgccatgccaga

SEQ ID NO: 742 - protein, 30 aa, Artificial
  HepC 1a segment 168
SVEEACSLTPPHSAKSKFGYGAKDVRCHAR

SEQ ID NO: 743 - DNA, 90 bp, Artificial
  HepC 1a segment 169
  CDS (1)..(90)
agcaaattcggatacggagccaaagacgtcaggtgtcacgctaggaaagccgtcgcccatatcaatagcgtctggaaagacctcctggaa

SEQ ID NO: 744 - protein, 30 aa, Artificial
  HepC 1a segment 169
SKFGYGAKDVRCHARKAVAHINSVWKDLLE

SEQ ID NO: 745 - DNA, 90 bp, Artificial
  HepC 1a segment 170
  CDS (1)..(90)
aaggctgtggctcacattaactccgtgtggaaggatctgctcgaggatagcgtcacccctatcgataccacaatcatggccaaaaacgaa

SEQ ID NO: 746 - protein, 30 aa, Artificial
  HepC 1a segment 170
KAVAHINSVWKDLLEDSVTPIDTTIMAKNE

SEQ ID NO: 747 - DNA, 90 bp, Artificial
  HepC 1a segment 171
  CDS (1)..(90)
gactccgtgacacccattgacacaaccattatggctaagaatgaggtcttctgtgtgcaacccgaaaagggaggcagaaagcctgccaga

SEQ ID NO: 748 - protein, 30 aa, Artificial
  HepC 1a segment 171
DSVTPIDTTIMAKNEVFCVQPEKGGRKPAR

SEQ ID NO: 749 - DNA, 90 bp, Artificial
  HepC 1a segment 172
  CDS (1)..(90)
gtgttttgcgtccagcctgagaaaggcggaaggaaacccgctaggctcatcgtcttccctgacctcggcgtcagggtctgcgaaaagatg

SEQ ID NO: 750 - protein, 30 aa, Artificial
  HepC 1a segment 172
VFCVQPEKGGRKPARLIVFPDLGVRVCEKM

SEQ ID NO: 751 - DNA, 90 bp, Artificial
  HepC 1a segment 173
  CDS (1)..(90)
ctgattgtgtttcccgatctgggagtgagagtgtgtgagaaaatggctctgtatgacgtcgtgtccaagctccccctcgccgtcatggga

SEQ ID NO: 752 - protein, 30 aa, Artificial
  HepC 1a segment 173
LIVFPDLGVRVCEKMALYDVVSKLPLAVMG

SEQ ID NO: 753 - DNA, 90 bp, Artificial
  HepC 1a segment 174
  CDS (1)..(90)
gccctctacgatgtggtcagcaaactgcctctggctgtgatgggctccagctatggctttcagtatagccctggccaaagggtcgagttt

SEQ ID NO: 754 - protein, 30 aa, Artificial
  HepC 1a segment 174
ALYDVVSKLPLAVMGSSYGFQYSPGQRVEF

SEQ ID NO: 755 - DNA, 90 bp, Artificial
  HepC 1a segment 175
  CDS (1)..(90)
agctcctacggattccaatactcccccggacagagagtggaattcctcgtgcaagcctggaagtccaagaaaacccctatgggattctcc

SEQ ID NO: 756 - protein, 30 aa, Artificial
  HepC 1a segment 175
SSYGFQYSPGQRVEFLVQAWKSKKTPMGFS

SEQ ID NO: 757 - DNA, 90 bp, Artificial
  HepC 1a segment 176
  CDS (1)..(90)
ctggtccaggcttggaaaagcaaaaagacacccatgggctttagctatgacacaaggtgtttcgatagcacagtgacagagtccgacatt

SEQ ID NO: 758 - protein, 30 aa, Artificial
  HepC 1a segment 176
LVQAWKSKKTPMGFSYDTRCFDSTVTESDI

SEQ ID NO: 759 - DNA, 90 bp, Artificial
  HepC 1a segment 177
  CDS (1)..(90)
tacgataccagatgctttgactccaccgtcaccgaaagcgatatcagaaccgaagaggctatctatcagtgttgcgatctggatccccaa

SEQ ID NO: 760 - protein, 30 aa, Artificial
  HepC 1a segment 177
YDTRCFDSTVTESDIRTEEAIYQCCDLDPQ

SEQ ID NO: 761 - DNA, 90 bp, Artificial
  HepC 1a segment 178
  CDS (1)..(90)
aggacagaggaagccatttaccaatgctgtgacctcgaccctcaggctagggtcgccattaagtccctgacagagagactgtatgtggga

SEQ ID NO: 762 - protein, 30 aa, Artificial
  HepC 1a segment 178
RTEEAIYQCCDLDPQARVAIKSLTERLYVG

SEQ ID NO: 763 - DNA, 90 bp, Artificial
  HepC 1a segment 179
  CDS (1)..(90)
gccagagtggctatcaaaagcctcaccgaaaggctctacgtcggcggacccctcaccaatagcagaggcgaaaactgtggctataggaga

SEQ ID NO: 764 - protein, 30 aa, Artificial
  HepC 1a segment 179
ARVAIKSLTERLYVGGPLTNSRGENCGYRR

SEQ ID NO: 765 - DNA, 90 bp, Artificial
  HepC 1a segment 180
  CDS (1)..(90)
ggccctctgacaaactccaggggagagaattgcggatacagaaggtgtagggctagcggagtgctcaccacaagctgtggcaataccctc

SEQ ID NO: 766 - protein, 30 aa, Artificial
  HepC 1a segment 180
GPLTNSRGENCGYRRCRASGVLTTSCGNTL

SEQ ID NO: 767 - DNA, 90 bp, Artificial
  HepC 1a segment 181
  CDS (1)..(90)
tgcagagcctccggcgtcctgacaacctcctgcggaaacacactgacatgctatatcaaagccagagccgcttgcagagccgctggcctc

SEQ ID NO: 768 - protein, 30 aa, Artificial
  HepC 1a segment 181
CRASGVLTTSCGNTLTCYIKARAACRAAGL

SEQ ID NO: 769 - DNA, 90 bp, Artificial
  HepC 1a segment 182
  CDS (1)..(90)
acctgttacattaaggctagggctgcctgtagggctgccggactgcaagactgtaccatgctggtctgcggagacgatctggtcgtgatt

SEQ ID NO: 770 - protein, 30 aa, Artificial
  HepC 1a segment 182
TCYIKARAACRAAGLQDCTMLVCGDDLVVI

SEQ ID NO: 771 - DNA, 90 bp, Artificial
  HepC 1a segment 183
  CDS (1)..(90)
caggattgcacaatgctcgtgtgtggcgatgacctcgtggtcatctgtgagtccgccggagtgcaagaggatgccgctagcctcagggct

SEQ ID NO: 772 - protein, 30 aa, Artificial
  HepC 1a segment 183
QDCTMLVCGDDLVVICESAGVQEDAASLRA

SEQ ID NO: 773 - DNA, 90 bp, Artificial
  HepC 1a segment 184
  CDS (1)..(90)
tgcgaaagcgctggcgtccaggaagacgctgcctccctgagagcctttaccgaagccatgaccagatactccgcccctcccggagaccct

SEQ ID NO: 774 - protein, 30 aa, Artificial
  HepC 1a segment 184
CESAGVQEDAASLRAFTEAMTRYSAPPGDP

SEQ ID NO: 775 - DNA, 90 bp, Artificial
  HepC 1a segment 185
  CDS (1)..(90)
ttcacagaggctatgacaaggtatagcgctccccctggcgatccccctcagcctgagtatgacctcgagctcatcacaagctgtagctcc

SEQ ID NO: 776 - protein, 30 aa, Artificial
  HepC 1a segment 185
FTEAMTRYSAPPGDPPQPEYDLELITSCSS

SEQ ID NO: 777 - DNA, 90 bp, Artificial
  HepC 1a segment 186
  CDS (1)..(90)
ccccaacccgaatacgatctggaactgattacctcctgctccagcaatgtgtccgtggctcacgatggcgctggcaaaagggtctactat

SEQ ID NO: 778 - protein, 30 aa, Artificial
  HepC 1a segment 186
PQPEYDLELITSCSSNVSVAHDGAGKRVYY

SEQ ID NO: 779 - DNA, 90 bp, Artificial
  HepC 1a segment 187
  CDS (1)..(90)
aacgtcagcgtcgcccatgacggagccggaaagagagtgtattacctcaccagagaccctaccacacccctcgccagagccgcttgggaa

SEQ ID NO: 780 - protein, 30 aa, Artificial
  HepC 1a segment 187
NVSVAHDGAGKRVYYLTRDPTTPLARAAWE

SEQ ID NO: 781 - DNA, 90 bp, Artificial
  HepC 1a segment 188
  CDS (1)..(90)
ctgacaagggatcccacaacccctctggctagggctgcctgggagacagccagacacacacccgtcaactcctggctcggcaatatcatt

SEQ ID NO: 782 - protein, 30 aa, Artificial
  HepC 1a segment 188
LTRDPTTPLARAAWETARHTPVNSWLGNII

SEQ ID NO: 783 - DNA, 90 bp, Artificial
  HepC 1a segment 189
  CDS (1)..(90)
accgctaggcatacccctgtgaatagctggctgggaaacattatcatgttcgctcccacactgtgggccagaatgattctgatgacccat

SEQ ID NO: 784 - protein, 30 aa, Artificial
  HepC 1a segment 189
TARHTPVNSWLGNIIMFAPTLWARMILMTH

SEQ ID NO: 785 - DNA, 90 bp, Artificial
  HepC 1a segment 190
  CDS (1)..(90)
atgtttgcccctaccctctgggctaggatgatcctcatgacacactttttctccgtgctcatcgctagggatcagctcgagcaagccctc

SEQ ID NO: 786 - protein, 30 aa, Artificial
  HepC 1a segment 190
MFAPTLWARMILMTHFFSVLIARDQLEQAL

SEQ ID NO: 787 - DNA, 90 bp, Artificial
  HepC 1a segment 191
  CDS (1)..(90)
ttctttagcgtcctgattgccagagaccaactggaacaggctctggattgcgaaatctatggcgcttgctatagcattgagcctctggat

SEQ ID NO: 788 - protein, 30 aa, Artificial
  HepC 1a segment 191
FFSVLIARDQLEQALDCEIYGACYSIEPLD

SEQ ID NO: 789 - DNA, 90 bp, Artificial
  HepC 1a segment 192
  CDS (1)..(90)
gactgtgagatttacggagcctgttactccatcgaacccctcgacctcccccctatcattcagagactgcatggcctcagcgctttctcc

SEQ ID NO: 790 - protein, 30 aa, Artificial
  HepC 1a segment 192
DCEIYGACYSIEPLDLPPIIQRLHGLSAFS

SEQ ID NO: 791 - DNA, 90 bp, Artificial
  HepC 1a segment 193
  CDS (1)..(90)
ctgcctcccattatccaaaggctccacggactgtccgcctttagcctccactcctactcccccggagagattaacagagtggctgcctgt

SEQ ID NO: 792 - protein, 30 aa, Artificial
  HepC 1a segment 193
LPPIIQRLHGLSAFSLHSYSPGEINRVAAC

SEQ ID NO: 793 - DNA, 90 bp, Artificial
  HepC 1a segment 194
  CDS (1)..(90)
ctgcatagctatagccctggcgaaatcaatagggtcgccgcttgcctcaggaaactgggagtgcctcccctcagggcttggagacacaga

SEQ ID NO: 794 - protein, 30 aa, Artificial
  HepC 1a segment 194
LHSYSPGEINRVAACLRKLGVPPLRAWRHR

SEQ ID NO: 795 - DNA, 90 bp, Artificial
  HepC 1a segment 195
  CDS (1)..(90)
ctgagaaagctcggcgtcccccctctgagagcctggaggcatagggctaggtccgtgagagccagactgctcgccagaggcggaagggct

SEQ ID NO: 796 - protein, 30 aa, Artificial
  HepC 1a segment 195
LRKLGVPPLRAWRHRARSVRARLLARGGRA

SEQ ID NO: 797 - DNA, 90 bp, Artificial
  HepC 1a segment 196
  CDS (1)..(90)
gccagaagcgtcagggctaggctcctggctaggggaggcagagccgctatctgtggcaaatacctcttcaattgggctgtgagaaccaaa

SEQ ID NO: 798 - protein, 30 aa, Artificial
  HepC 1a segment 196
ARSVRARLLARGGRAAICGKYLFNWAVRTK

SEQ ID NO: 799 - DNA, 90 bp, Artificial
  HepC 1a segment 197
  CDS (1)..(90)
gccatttgcggaaagtatctgtttaactgggccgtcaggacaaagctcaagctcacccctatcgctgccgctggcagactggatctgtcc

SEQ ID NO: 800 - protein, 30 aa, Artificial
  HepC 1a segment 197
AICGKYLFNWAVRTKLKLTPIAAAGRLDLS

SEQ ID NO: 801 - DNA, 90 bp, Artificial
  HepC 1a segment 198
  CDS (1)..(90)
ctgaaactgacacccattgccgctgccggaaggctcgacctcagcggatggtttaccgctggctatagcggaggcgatatctatcactcc

SEQ ID NO: 802 - protein, 30 aa, Artificial
  HepC 1a segment 198
LKLTPIAAAGRLDLSGWFTAGYSGGDIYHS

SEQ ID NO: 803 - DNA, 90 bp, Artificial
  HepC 1a segment 199
  CDS (1)..(90)
ggctggttcacagccggatactccggcggagacatttaccatagcgtcagccatgccagacccagatggttttggttttgcctcctgctc

SEQ ID NO: 804 - protein, 30 aa, Artificial
  HepC 1a segment 199
GWFTAGYSGGDIYHSVSHARPRWFWFCLLL

SEQ ID NO: 805 - DNA, 90 bp, Artificial
  HepC 1a segment 200
  CDS (1)..(90)
gtgtcccacgctaggcctaggtggttctggttctgtctgctcctgctcgccgctggcgtcggcatttacctcctgcctaacagagccgct

SEQ ID NO: 806 - protein, 30 aa, Artificial
  HepC 1a segment 200
VSHARPRWFWFCLLLLAAGVGIYLLPNRAA

SEQ ID NO: 807 - DNA, 45 bp, Artificial
  HepC 1a segment 201
  CDS (1)..(45)
ctggctgccggagtgggaatctatctgctccccaatagggctgcc

SEQ ID NO: 808 - protein, 15 aa, Artificial
  HepC 1a segment 201
LAAGVGIYLLPNRAA

SEQ ID NO: 809 - DNA, 17955 bp, Artificial
  HepC 1a savine
  CDS (1)..(17955)
gtgattcccgtcaggagaaggggagactccaggggaagcctcctgtcccccagacccattagctatctgaaaggctccagcggaggccctgccagaaggggaagggaaatcctcctgggacccgctgacggaatggtcagcaaaggctggaggctcctggctcccattaccgcttacgctaggctccacagattcgctcccccttgcaaacccctcctgagagaggaagtgtccttcagagtgggactgcatgagtatcccgtcggctccgtggtcttctcccagatggagacaaagctcatcacatggggagccgataccgctgcctgtggcgatatcattaacggactgcctgtgtccctgctctgccctgccggacacgctgtgggaatctttagggctgccgtctgcacaaggggagtggctaaggctgtggatttcattcccgtctgcgtcgtgattgtgggaaggattgtgctcagcggaaagcctgccattatccctgacagagaggtcctgtatagggaattcgatgagatgccctgtacccctctgcctgcccctaactatacctttgccctctggagagtgtccgccgaagagtatgtggaaatcagaagggtcggcgatgccctctacgatgtggtcagcaaactgcctctggctgtgatgggctccagctatggctttcagtatagccctggccaaagggtcgagtttatctcctggtgtctgtggtggctccagtatttcctcaccagagtggaagcccaactgcatgtgtgggtgcctcccctcaacgtcaggggagagaatctggtcatcctcaacgctgcctccctggctggcacacacggactggtcagctttctggtcttcttttgctttgcctggtacctcctgcctcccattatccaaaggctccacggactgtccgcctttagcctccactcctactcccccggagagattaacagagtggctgcctgtaaccctcccctcgtggaaacctggaagaaacccgattacgaaccccctgtggtccacggatgccctctgcctccccctaggtccccccctggcgtcggctccagcattgcctcctgggctatcaaatgggaatacgtcgtgctcctgtttctgctcctggctgacgctagggtctgctccctgaataacacaaggcctcccctcggcaattggtttggctgtacctggatgaatagcacaggctttaccaaagtgtgtggcgctccccctttcacagaggctatgacaaggtatagcgctccccctggcgatccccctcagcctgagtatgacctcgagctcatcacaagctgtagctcctggcctctgctcctgctcctgctcgccctcccccaaagggcttacgctctggataccgaagtggctgcctcctgcggaggcgtcgtgctccagcaaaccagaggcctcctgggatgcattatcacaagcctcaccggaagggataagaatcaggtcgagggagaggtccagattgtgtccagctccccccctgccgtcccccaaagctttcaggtcgcccatctgcatgcccctaccggaagcggaaagtccaccaaagtgcctgccgctaacacacccggactgcctgtgtgtcaggatcacctcgagttttgggaaggcgtcttcacaggcctcacccatatcgatgcccatttcctcgtgctcctgctcttcgctggcgtcgacgctgagacacacgtcaccggaggcaatgccggaaggacaacctccggcctcgtgtccctgctcgaggtcaccctcacccatcccgtcaccaaatacattatgacatgcatgagcgctgacctcgaggtcgtgacaagcacatgggtcctggtcgtgggactgatggccctcaccctcagcccttactataagagatacattagctggtgcctctggtggctgcaatactttctgacaagggtcgccatttgcggaaagtatctgtttaactgggccgtcaggacaaagctcaagctcacccctatcgctgccgctggcagactggatctgtccatcgcttactttagcatggtgggaaactgggccaaagtgctcgtggtcctgctcctgtttgccggagtggatgccgaaacccatgtgacaaggctcgccagaggctccccccctagcatggcctccagctccgcctcccagctcagcgctccctccctgaaagccacatgcacagccaatggcctcgtgtccttcctcgtgtttttctgtttcgcttggtatctgaaaggcagatgggtccccggagccgtctacgctctgtatggcatgcagctcccctgtgagcctgagcctgacgtcgccgtcctgacaagcatgctgacagaccctagccatatcacagccgaagccgctggcagagactccgtgacacccattgacacaaccattatggctaagaatgaggtcttctgtgtgcaacccgaaaagggaggcagaaagcctgccagatacgctgcccaaggctataaggtcctggtcctgaatccctccgtggctgccacactgggattcggagcctatatgtccaaggctcacggagtgagaaactccaccggactgtatcacgtcaccaatgactgtcccaatagctccatcgtctacgaagccgctgacgctatcctccacacaagctcctacggattccaatactcccccggacagagagtggaattcctcgtgcaagcctggaagtccaagaaaacccctatgggattctccgacacagccgcttgcggagacattatcaatggcctccccgtcagcgctaggagaggcagagagattctgctcggccctgccgatggcatgagccaactgtccgcccctagcctcaaggctacctgtaccgctaaccatgactcccccgatgccgaactgattgaggctaacctcctgtggaaccctgccattgcctccctgatggcctttaccgctgccgtcacctcccccctcaccacaagccaaaccctcctgtttaacattctgggactggtccaggcttggaaaagcaaaaagacacccatgggctttagctatgacacaaggtgtttcgatagcacagtgacagagtccgacattgacgaaagggaaatctccgtgcctgccgaaatcctcaggaaaagcagaaggtttgcccaagccctccccgtctgggctaggcctgactatatgtttgcccctaccctctgggctaggatgatcctcatgacacactttttctccgtgctcatcgctagggatcagctcgagcaagccctcagcgtcatccctacctccggcgatgtggtcgtggtcgccacagacgctctgatgaccggatacacaggcgatttcgatagcgtcatcgattgccatagcaaaaagaaatgcgatgagctcgccgctaagctcgtggctctgggaatcaatgccgtcgcctattacagaggcctcgacgtcgtgctcccctgtagctttaccacactgcctgccctcagcacaggcctcatccatctgcatcagaatatcgtcgacgtccagtatctgtataagggaaggtgggtgcctggcgctgtgtatgccctctacggaatgtggcccctcctgctcctgctcctggctctgcctcagagagcctatagccctatcacatactccacctatggcaaattcctcgccgatggcggatgctccggcggagcctatgacattatcatttgcgatgagtgtgccagaagcgtcagggctaggctcctggctaggggaggcagagccgctatctgtggcaaatacctcttcaattgggctgtgagaaccaaaaaggctgtggctcacattaactccgtgtggaaggatctgctcgaggatagcgtcacccctatcgataccacaatcatggccaaaaacgaattcacaccctcccccgtcgtggtcggcacaaccgataggtccggcgctcccacatactcctggggagccaatgacacagacgtcttcgtccccggatgcgtcccctgtgtgagagagggaaacgctagcagatgctgggtggctatgacacccacagtggctaccagagacggaaagctccaggattgcacaatgctcgtgtgtggcgatgacctcgtggtcatctgtgagtccgccggagtgcaagaggatgccgctagcctcagggctgtggctggcgctctggtcgcctttaagattatgtccggcgaagtgcctagcacagaggatctggtcaacctcctgcctgccattctgtcctacgataccagatgctttgactccaccgtcaccgaaagcgatatcagaaccgaagaggctatctatcagtgttgcgatctggatccccaagagctcacccctgccgaaaccacagtgagactgagagcctatatgaatacccctggcctccccgtctgccaagaccatctggaattctggccccaacccgaatacgatctggaactgattacctcctgctccagcaatgtgtccgtggctcacgatggcgctggcaaaagggtctactatctgggaaaggtcatcgataccctcacctgtggctttgccgatctgatgggctatatccctctggtcggcgctcccctcggcggagccgctgccattcccctcgaggtcatcaaaggcggaaggcatctgattttctgtcactccaagaaaaagtgtgacgaactggctgccaaactggtcggcggagtgctcgccgctctggctgcctattgcctcagcacaggctgtgtggtcatcgtcggcagaatcgtcctgtccggcaaacccgcttgcgaaagcgctggcgtccaggaagacgctgcctccctgagagcctttaccgaagccatgaccagatactccgcccctcccggagaccctggctggttcacagccggatactccggcggagacatttaccatagcgtcagccatgccagacccagatggttttggttttgcctcctgctcagctccagcacaagcggaatcacaggcgataacacaaccacaagctccgagcctgcccctagcggatgccctcccgatagcgatgccgaaaggacacagagaaggggaaggacaggcagaggcaaacccggaatctataggtttgtggctcccggagagagaccctccggcatgttcgatgtgagaatgtatgtgggaggcgtcgagcataggctcgaggctgcctgtaactggaccagaggcgaaaggtgtgacctcgaggatagggatgaggctcagctccacgtctgggtcccccctctgaatgtgagaggcggaagggatgccgtcatcctcctgatgtgcgtcgtgcatcccacactgggagtgagagccacaaggaaaacctccgagagaagccaacccagaggcagaaggcaacccattcccaaagccagaaggcctgagggaaacgtcagcgtcgcccatgacggagccggaaagagagtgtattacctcaccagagaccctaccacacccctcgccagagccgcttgggaaagcgaacccgctccctccggctgtccccctgactccgacgctgagtcctactccagcatgccccctctggaaggcgaacccggagaccctatcggaggccattacgtccagatggccattatcaaactgggagccctcaccggaacctatgtgtataaccatctgacacccctcagggatccctccaccgaagacctcgtgaatctgctccccgctatcctcagccctggcgctctggtcgtgggagtggtctgcgctgccattctgagaatcctcgacatgatcgctggcgctcactggggcgtcctggctggcattgcctatttctccatggtcggcaattgggctaaggtcctggtcgagggatgcggatgggctggctggctgctcagccctaggggaagcagaccctcctggggacccacagaccctaggagaaggtccaggaattggacaacccaaggctgtaactgtagcatttaccctggccatatcacaggccataggatggcctgggacatgatgatgaactggagcccttgggtcgccatgacccctaccgtcgccacaagggatggcaaactgcctgccacacagctcaggagacacattgacctcctggtcggctccaggctctggcattacccttgcacaatcaattacacaatctttaaggtcaggatgtacgtcggcggagtggaacacagactggaagccgctgtgttttgcgtccagcctgagaaaggcggaaggaaacccgctaggctcatcgtcttccctgacctcggcgtcagggtctgcgaaaagatgatgggatacattcccctcgtgggagcccctctgggaggcgctgccagagccctcgcccatggcgtcagggtcctggaagacggagtgaatggcggaaacgctggcagaaccacaagcggactggtcagcctcctgacacccggagccaaacagaatatccaactgattaacacaaacggactggctctgctcagctgtctgacagtgcctgcctccgcctatcaggtcaggaatagcacaggcctctaccatgtgacaaacgattgccctggcagagacaaaaaccaagtggaaggcgaagtgcaaatcgtcagcacagccgctcagacattcctcgccacatgcattaacggagtgtgtcccgctacccaactgagaaggcatatcgatctgctcgtgggaagcgctaccctctgctccgccctctacgtcggcgatctgtgtggctcccacgctcccacaggctccggcaaaagcacaaaggtccccgctgcctatgccgctcagggatacaaagtgctcgtgctcaaccctagcgtcaggacatgggctcagcctggctatccctggcccctctacggaaacgaaggctgtggctgggccggatggctcctgtcccccagaggctccaccgaagacgtcgtgtgttgctccatgtcctactcctggacaggcgctctggtcaccccttgcgctgccgaagagcaaaagctccccattgccctcgacacagaggtcgccgctagctgtggcggagtggtcctggtcggcctcatggctctgacactgtccccctattacaaaaggtattggatgaactccaccggattcacaaaggtctgcggagcccctccctgtgtgattggcggagccggaaacaataccctccactgtcccacaagcgtcgaggaagcctgtagcctcacccctccccatagcgctaagtccaagtttggctatggcgctaaggatgtgagatgccatgccagaatctccggcattcagtatctggctggcctcagcacactgcctggcaatcccgctatcgctagcctcatggctttcacagccgctgtgacacagattgtgggaggcgtctacctcctgcctaggagaggccctaggctcggcgtcagggctaccagaaagacaagcgaaaggtcccagcctctgcatagctatagccctggcgaaatcaatagggtcgccgcttgcctcaggaaactgggagtgcctcccctcagggcttggagacacagaaccgctaggcatacccctgtgaatagctggctgggaaacattatcatgttcgctcccacactgtgggccagaatgattctgatgacccatgagaatctggaaaccacaatgagaagccctgtgtttaccgataactccagccctcccgctgtgcctcagtccttccaagtggctcacctcgccacaccccctggctccgtgacagtgcctcaccctaacattgaggaagtggctctgtccaccacaggcgaaatccctttctatggcaaactggtcttcgatatcacaaagctcctgctcgccgtcttcggacccctctggattctgcaagcctccctgctcaaggtcccctatttcgtcaccgctgccctcgtgatggcccaactgctcaggattccccaagccattctggatatgattgccggagcccattggggagtgctcgccggatgcaatacctgtgtgacacagacagtggatttctccctggatcccacattcacaatcgaaaccacaaccctcccccaagacgctgtgtcccacggacccacacccctcctgtataggctcggcgctgtgcaaaacgaagtgacactgacacaccctgtgacaaagtatatcatgacctgtgccagagtggctatcaaaagcctcaccgaaaggctctacgtcggcggacccctcaccaatagcagaggcgaaaactgtggctataggagatgcgtcatcggaggcgctggcaataacacactgcattgccctaccgattgctttaggaaacaccctgaggctacctatagcagatgcggaacctgtggctccagcgatctgtatctggtcaccagacacgctgacgtcatccctgtgagaaggagaggcgatagcagaggctccctgctcaacatgtggtccggcacattccctatcaatgcctataccacaggcccttgcacacccctccccgctcccaattacacattcgctctgtggcactccaccgatgccacaagcattctgggaatcggaaccgtcctggatcaggctgagacagccggagccagactggtcgtgctcgccacatacgtccccgaaagcgatgccgctgccagagtgacagccattctgtccagcctcaccgtcacccaactgctcaggagactgcatcagtggaggcctagctggggccctaccgatcccagaaggagaagcagaaacctcggcaaagtgattgacacactgacatgcggattcgctgacctcggccctgaccaaaggccttactgttggcattaccctcccaaaccctgtggcattgtgcctgccaaaagcgtctgcggacccgtctactgtgaggaatgctcccagcatctgccttacattgagcaaggcatgatgctcgccgaacagtttaagcaaaaggctctgggactgctccagacataccaagccacagtgtgtgccagagcccaagcccctccccctagctgggaccaaatgtggaagtgtctgattaggctcaagcctaccctctgcggaatcgtccccgctaagtccgtgtgtggccctgtgtattgctttacccctagccctgtggtcgtgggaaccacagacagaagcggaagctccctgacagtgacacagctcctgagaaggctccaccaatggattagctccgagtgtaccacaccctgtagcggaagctggctgagagacctcagcgatggctcctggtccaccgtcagctccgaggctggcacagaggatgtggtctgctgtagcatgagctatagctggaccggatgggatcagatgtggaaatgcctcatcagactgaaacccacactgcatggccctacccctctgctctacagactgggagccgtccagaatctggctgagcaattcaaacagaaagccctcggcctcctgcaaaccgctagcagacaggctgaggtcatcgctcccgctgtgcaaaccaattggcaaaagctcgaggtcttctgggccaaacacatgtggaatttcattagcggaatccaatacctcgccggactgtccaccctccccggactgattgcctttgcctccaggggaaaccatgtgtcccccacacactatgtgcctgagtccgacgctgccgctagggtcaccgctatcctcgccacactgtgtagcgctctgtatgtgggagacctctgcggaagcgtcttcctcgtgggacagctcttcacattctcccccagaaggcatagctccgtgctctgcgaatgctatgacgctggctgtgcctggtacgaactgacacccgctgagacaaccgtcaggctcagggcttacatgggctgggtggctgcccaactggctgcccctggcgctgccacagcctttgtgggagccggactggctggcgctgccattggctccgtgggaagctggcacattaactccaccgctctgaattgcaatgagtccctgaataccggatggctcgccggactgttttaccaacacaaattcaataacgctctgtccaactccctgctcaggcatcacaatctggtctactccaccacaagcagaagcgcttgccaaaggcaaaagaaagtgacagccgctatgtccaccaatcccaaaccccaaaggaaaaccaaaaggaataccaataggagaccccaagacgtcaagtttcccggaggcggaagccaaaccaaacagtccggcgaaaactttccctatctggtcgcctatcaggctaccgtctgcgctagggctcaggctccccctccctccgcccctacctatagctggggcgctaacgataccgatgtgtttgtgctcaacaataccagaccccctctgggaaactggttcggatgcacagtgcctccccctaggaaaaagagaaccgtcgtgctcaccgaaagcacactgtccaccgctctggctgagctcgccacaaagtccttcggaagcacaacctccaggtccgcctgtcagagacagaaaaaggtcacctttgacagactgcaagtgctcgactcccactatcaggatgtgctcgaccaagccgaaaccgctggcgctaggctcgtggtcctggctaccgctacccctcccggaagcgtcaccgtcccccatcccaatatcgaattccattacgtcaccggaatgacaaccgataacctcaagtgtccctgtcaggtcccctcccccgaattctttaccgaactggatggcgtcctgaaactgacacccattgccgctgccggaaggctcgacctcagcggatggtttaccgctggctatagcggaggcgatatctatcactccgcctccaggcaagccgaagtgattgcccctgccgtccagacaaactggcagaaactggaagtgttttgggctaagcatatgtggaacttttgcagagcctccggcgtcctgacaacctcctgcggaaacacactgacatgctatatcaaagccagagccgcttgcagagccgctggcctcttcgataggctccaggtcctggatagccattaccaagacgtcctgaaagaggtcaaggctgccgctagcaaagtgaaagccaatctgctcggccctctgacaaactccaggggagagaattgcggatacagaaggtgtagggctagcggagtgctcaccacaagctgtggcaataccctcatcatgcacacaaggtgtcactgtggcgctgagattaccggacacgtcaagaatggcacaatgagaatcgtcggccctaggacatgcagagaggtcagctttagggtcggcctccacgaataccctgtgggaagccaactgccttgcgaacccgaacccgatgtggctgtgctcacctccaaggaagtgaaagccgctgcctccaaggtcaaggctaacctcctgtccgtggaagaggcttgctccctgacaccccctcactccgccaaaggcagagacgctgtgattctgctcatgtgtgtggtccaccctaccctcgtgtttgacattaccaaactgctcctggctgtgtttggccctatgctcaccgatccctcccacattaccgctgaggctgccggaaggagactggctaggggaagccctccctccatggctagctccagcgctagccctaggcctatctcctacctcaagggaagctccggcggacccctcctgtgtcccgctggccatgccgtcggcattttcagagccgctgactttgaccaaggctggggccctatctcctacgctaacggaagcggacccgatcagagaccctattgctggcactatccccctaagcctaggcatgtgggacccggagagggagccgtccagtggatgaataggctcatcgctttcgctagcagaggcaatcacgtcagccctacccattgcctctggatgatgctcctgattagccaagccgaagccgctctggaaaacctcgtgattctgaatgccgctagcctcgccggaacccatatcattcccgatagggaagtgctctacagagagtttgacgaaatggaagagtgtagccaacacctcccctatatcgaacagggaatgatgctgattcacctccaccaaaacattgtggatgtgcaatacctctacggagtgggaagctccatcgctagctgggccattaagtgggagtatgtgtcccacgctaggcctaggtggttctggttctgtctgctcctgctcgccgctggcgtcggcatttacctcctgcctaacagagccgctgccgctaccctcggctttggcgcttacatgagcaaagcccatggcattgaccctaacattaggacaggcgtcaggacaatcacaaccggaagggtccagggactgctcaggatttgcgctctggctaggaaaatgattggcggacactatgtgcaaatggctatcattaagctcggcgctaggagattcgctcaggctctgcctgtgtgggccagacccgattacaatccccctctggtcgagacatggaaaaagcctgactatgagcctaccgctgcccaaacctttctggctacctgtatcaatggcgtctgctggaccgtctaccatggcgctggcacaaggacaatcgctagcccttgggctcacaatggcctcagggatctggctgtggctgtggaacccgtcgtgtttagccaaatggaaaccaaactgattacctggggcgctaagggacccgtcatccaaatgtataccaatgtggatcaggatctggtcggctggcccgctccccaaggctccaggtccctgacaccctgtaaggtcgtgattctggatagctttgaccctctggtcgccgaagaggatgagagagagattagcgtccccgctgagattctgagaaagtccctgacaggcacatacgtctacaatcacctcacccctctgagagactgggcccataacggactgagagacctcgccgtcgccgtcgagcctgtgtgtaccagaggcgtcgccaaagccgtcgactttatccctgtggaaaacctcgagacaaccatgaggtcccccgtcttcacagacaatgccctcggcattaacgctgtggcttactataggggactggatgtgtccgtgattcccacaagcggagacgtcgtggtcgtggctaccgatatgtccgccgatctggaagtggtcacctccacctgggtgctcgtgggaggcgtcctggctgccctcgccgcttactgtctgtccaccggagccctcatgacaggctataccggagactttgactccgtgattgactgtaacacatgcgtcacccaaaccgtcgactttagcctcgaccctaacacaaacagaaggcctcaggatgtgaaattccctggcggaggccaaatcgtcggcggagtgtatctgctccccagaaggggacccagaagggctctggctcacggagtgagagtgctcgaggatggcgtcaactatgccacaggcaatctgcctggctgtagctttagcattttcctcagcaaattcggatacggagccaaagacgtcaggtgtcacgctaggaaagccgtcgcccatatcaatagcgtctggaaagacctcctggaaacccctggcgctaagcaaaacattcagctcatcaataccaatggctcctggcatatcaatagcacagccctcaactgtaacgaaagcctcaacacaggctggctggctggcctcttctatcagcataagtttaactccagcggatgccctgagagactggctagctgtaggagactgacagtggtcctgctcttcctcctgctcgccgatgccagagtgtgtagctgtctgtggatgatgctgctcatctcccaggctgaggctgccctcgactgtgagatttacggagcctgttactccatcgaacccctcgacctcccccctatcattcagagactgcatggcctcagcgctttctcctggacagtgtatcacggagccggaaccagaaccattgcctcccccaaaggccctgtgattcagatgtacacaaacgtcgaccaagacctctacagattcgtcgcccctggcgaaaggcctagcggaatgtttgactccagcgtcctgtgtgagtgttacgatgccggatgcgcttggtataggtccgagctcagccctctgctcctgtccaccacacagtggcaggtcctgccttgctccttcacaaccctccccgctctgtccaccggactgagaaagctcggcgtcccccctctgagagcctggaggcatagggctaggtccgtgagagccagactgctcgccagaggcggaagggctagccctctgacaacctcccagacactgctcttcaatatcctcggcggatgggtcgccgctcagctcgccgctcccggagccgctaccgctgtgaaaaacggaaccatgaggattgtgggacccagaacctgtaggaatatgtggagcggaacctttcccattaacgcttacacaaccggagaggtcgccctcagcacaaccggagagattcccttttacggaaaggctatccctctggaagtgattaagggaggcagacacctcatctttctgacaagggatcccacaacccctctggctagggctgcctgggagacagccagacacacacccgtcaactcctggctcggcaatatcattagggtcagcgctgaggaatacgtcgagattaggagagtgggagactttcactatgtgacaggcatgaccacagacaatctgaaatgccctcccgtcgtgcatggctgtcccctcccccctcccagaagccctcccgtcccccctcccagaaagaaaaggacagtggtcctgacagagtccaccctcagcacagccctcgccgaactggctaccaaaagctttggctccagctccacctccggcattaccggagacaataccacaacctccgtgtcctgccaaaggggatacaaaggcgtctggagaggcgatggcattatgcataccagatgccattgcggagccgaaatcacaggccatgtgtttctggtcggccaactgtttacctttagccctaggagacactggaccacacagggatgcaattgctccatctatcccggacacattttcgtcggcgctggcctcgccggagccgctatcggaagcgtcggcctcggcaaagtgctcgtggatatcctcgccggatacggagccggagacatttgggattggatttgcgaagtgctcagcgatttcaaaacctggctgaaagccaaactgatgccccaactgcctggcattccctttaactccagcattgtgtatgaggctgccgatgccattctgcatacccctggctgtgtgccttgcgtcagggaaggcaatgcctccaggtgtagctccggctgtcccgaaaggctcgcctcctgcagaaggctcaccgatttcgatcagggatggggacccattagctatgccaatggctccaggacagaggaagccatttaccaatgctgtgacctcgaccctcaggctagggtcgccattaagtccctgacagagagactgtatgtgggagtgtccaagggatggagactgctcgcccctatcacagcctatgcccaacagacaaggggactgctcggctgtatcattacctccctgacattctttagcgtcctgattgccagagaccaactggaacaggctctggattgcgaaatctatggcgcttgctatagcattgagcctctggattgccaagtgcctagccctgagtttttcacagagctcgacggagtgagactgcataggtttgcccctccctgtaagcctctgctcagggaaacctgttacattaaggctagggctgcctgtagggctgccggactgcaagactgtaccatgctggtctgcggagacgatctggtcgtgattatcgatcccaatatcagaaccggagtgagaaccattaccacaggctcccccattacctatagcacatacggaaagtttctggctgacggatgcaattggacaaggggagagagatgcgatctggaagacagagacagaagcgaactgtcccccctcctgctcagcacaacccaatggcaaaccggacacagaatggcttgggatatgatgatgaattggtcccccacagccgctctggtcatggctcagctcctgagaatccctcaggctcccggagccctcgtggtcggcgtcgtgtgtgccgctatcctcaggagacacgtcggccctggcgaaggcgctgtgcaatggatgaacagacacgatagccctgacgctgagctcatcgaagccaatctgctctggagacaggaaatgggaggcaatatcacaagggtcgagtccgagaatgagggagtgtttaccggactgacacacattgacgctcactttctgtcccagacaaagcaaagcggagagaatttcccttacctcgtggctaggggaaggagacagcctatccctaaggctaggagacccgaaggcagaacctgggcccaacccggatacccttggcctctgtatggcaatctgattgtgtttcccgatctgggagtgagagtgtgtgagaaaatggctctgtatgacgtcgtgtccaagctccccctcgccgtcatgggatacgctaccggaaacctccccggatgctccttctccatctttctgctcgccctcctgtcctgcctcaccgtccccgctagcgcttaccaactgggaaaggtcctggtcgacattctggctggctatggcgctggcgtcgccggagccctcgtggctttcaaaatcatgagcggagaggtcagctatagctccatgcctcccctcgagggagagcctggcgatcccgatctgtccgacggaagctggagcacagtgtccagcgaagccggaaggcaagagatgggcggaaacattaccagagtggaaagcgaaaacaaagtggtcatcctcgactccttcgatcccctcgtggctgaggaagtgggatggcctgcccctcagggaagcagaagcctcaccccttgcacatgcggaagctccgacctctacctcgtgacaaggcatgccgatggctgtagcggaggcgcttacgatatcattatctgtgacgaatgccatagcacagacgctacctccatcctcggcattggcacagtgctcacctttaccattgagacaaccacactgcctcaggatgccgtcagcagaacccaaaggagaggcagaaccggaaggggaaagcctggcattgactgtttcagaaagcatcccgaagccacatactccaggtgtggctccggcccttggattacccctaggtgtctggtcgactatccctatctggctgccggagtgggaatctatctgctccccaatagggctgccgccctcgtgacaccctgtgccgctgaggaacagaaactgcctatcaatgccctcagcaatagcctcctgagacaccataacctcgtgtatatctccagcgaatgcacaaccccttgctccggctcctggctcagggatatctgggactggatctgtgaggtcctgtccgactttaagacatggctcaaggctaagctcatgcctcagctccccggaatccctttcgtcagctgtcagagaggctataagggagtgtggaggggagacggaagcggaccctggatcacacccagatgcctcgtggattacccttacagactgtggcactatccctgtaccattaactataccattttcaaa

SEQ ID NO: 810 - protein, 5985 aa, Artificial
  HepC 1a savine
VIPVRRRGDSRGSLLSPRPISYLKGSSGGPARRGREILLGPADGMVSKGWRLLAPITAYARLHRFAPPCKPLLREEVSFRVGLHEYPVGSVVFSQMETKLITWGADTAACGDIINGLPVSLLCPAGHAVGIFRAAVCTRGVAKAVDFIPVCVVIVGRIVLSGKPAIIPDREVLYREFDEMPCTPLPAPNYTFALWRVSAEEYVEIRRVGDALYDVVSKLPLAVMGSSYGFQYSPGQRVEFISWCLWWLQYFLTRVEAQLHVWVPPLNVRGENLVILNAASLAGTHGLVSFLVFFCFAWYLLPPIIQRLHGLSAFSLHSYSPGEINRVAACNPPLVETWKKPDYEPPVVHGCPLPPPRSPPGVGSSIASWAIKWEYVVLLFLLLADARVCSLNNTRPPLGNWFGCTWMNSTGFTKVCGAPPFTEAMTRYSAPPGDPPQPEYDLELITSCSSWPLLLLLLALPQRAYALDTEVAASCGGVVLQQTRGLLGCIITSLTGRDKNQVEGEVQIVSSSPPAVPQSFQVAHLHAPTGSGKSTKVPAANTPGLPVCQDHLEFWEGVFTGLTHIDAHFLVLLLFAGVDAETHVTGGNAGRTTSGLVSLLEVTLTHPVTKYIMTCMSADLEVVTSTWVLVVGLMALTLSPYYKRYISWCLWWLQYFLTRVAICGKYLFNWAVRTKLKLTPIAAAGRLDLSIAYFSMVGNWAKVLVVLLLFAGVDAETHVTRLARGSPPSMASSSASQLSAPSLKATCTANGLVSFLVFFCFAWYLKGRWVPGAVYALYGMQLPCEPEPDVAVLTSMLTDPSHITAEAAGRDSVTPIDTTIMAKNEVFCVQPEKGGRKPARYAAQGYKVLVLNPSVAATLGFGAYMSKAHGVRNSTGLYHVTNDCPNSSIVYEAADAILHTSSYGFQYSPGQRVEFLVQAWKSKKTPMGFSDTAACGDIINGLPVSARRGREILLGPADGMSQLSAPSLKATCTANHDSPDAELIEANLLWNPAIASLMAFTAAVTSPLTTSQTLLFNILGLVQAWKSKKTPMGFSYDTRCFDSTVTESDIDEREISVPAEILRKSRRFAQALPVWARPDYMFAPTLWARMILMTHFFSVLIARDQLEQALSVIPTSGDVVVVATDALMTGYTGDFDSVIDCHSKKKCDELAAKLVALGINAVAYYRGLDVVLPCSFTTLPALSTGLIHLHQNIVDVQYLYKGRWVPGAVYALYGMWPLLLLLLALPQRAYSPITYSTYGKFLADGGCSGGAYDIIICDECARSVRARLLARGGRAAICGKYLFNWAVRTKKAVAHINSVWKDLLEDSVTPIDTTIMAKNEFTPSPVVVGTTDRSGAPTYSWGANDTDVFVPGCVPCVREGNASRCWVAMTPTVATRDGKLQDCTMLVCGDDLVVICESAGVQEDAASLRAVAGALVAFKIMSGEVPSTEDLVNLLPAILSYDTRCFDSTVTESDIRTEEAIYQCCDLDPQELTPAETTVRLRAYMNTPGLPVCQDHLEFWPQPEYDLELITSCSSNVSVAHDGAGKRVYYLGKVIDTLTCGFADLMGYIPLVGAPLGGAAAIPLEVIKGGRHLIFCHSKKKCDELAAKLVGGVLAALAAYCLSTGCVVIVGRIVLSGKPACESAGVQEDAASLRAFTEAMTRYSAPPGDPGWFTAGYSGGDIYHSVSHARPRWFWFCLLLSSSTSGITGDNTTTSSEPAPSGCPPDSDAERTQRRGRTGRGKPGIYRFVAPGERPSGMFDVRMYVGGVEHRLEAACNWTRGERCDLEDRDEAQLHVWVPPLNVRGGRDAVILLMCVVHPTLGVRATRKTSERSQPRGRRQPIPKARRPEGNVSVAHDGAGKRVYYLTRDPTTPLARAAWESEPAPSGCPPDSDAESYSSMPPLEGEPGDPIGGHYVQMAIIKLGALTGTYVYNHLTPLRDPSTEDLVNLLPAILSPGALVVGVVCAAILRILDMIAGAHWGVLAGIAYFSMVGNWAKVLVEGCGWAGWLLSPRGSRPSWGPTDPRRRSRNWTTQGCNCSIYPGHITGHRMAWDMMMNWSPWVAMTPTVATRDGKLPATQLRRHIDLLVGSRLWHYPCTINYTIFKVRMYVGGVEHRLEAAVFCVQPEKGGRKPARLIVFPDLGVRVCEKMMGYIPLVGAPLGGAARALAHGVRVLEDGVNGGNAGRTTSGLVSLLTPGAKQNIQLINTNGLALLSCLTVPASAYQVRNSTGLYHVTNDCPGRDKNQVEGEVQIVSTAAQTFLATCINGVCPATQLRRHIDLLVGSATLCSALYVGDLCGSHAPTGSGKSTKVPAAYAAQGYKVLVLNPSVRTWAQPGYPWPLYGNEGCGWAGWLLSPRGSTEDVVCCSMSYSWTGALVTPCAAEEQKLPIALDTEVAASCGGVVLVGLMALTLSPYYKRYWMNSTGFTKVCGAPPCVIGGAGNNTLHCPTSVEEACSLTPPHSAKSKFGYGAKDVRCHARISGIQYLAGLSTLPGNPAIASLMAFTAAVTQIVGGVYLLPRRGPRLGVRATRKTSERSQPLHSYSPGEINRVAACLRKLGVPPLRAWRHRTARHTPVNSWLGNIIMFAPTLWARMILMTHENLETTMRSPVFTDNSSPPAVPQSFQVAHLATPPGSVTVPHPNIEEVALSTTGEIPFYGKLVFDITKLLLAVFGPLWILQASLLKVPYFVTAALVMAQLLRIPQAILDMIAGAHWGVLAGCNTCVTQTVDFSLDPTFTIETTTLPQDAVSHGPTPLLYRLGAVQNEVTLTHPVTKYIMTCARVAIKSLTERLYVGGPLTNSRGENCGYRRCVIGGAGNNTLHCPTDCFRKHPEATYSRCGTCGSSDLYLVTRHADVIPVRRRGDSRGSLLNMWSGTFPINAYTTGPCTPLPAPNYTFALWHSTDATSILGIGTVLDQAETAGARLVVLATYVPESDAAARVTAILSSLTVTQLLRRLHQWRPSWGPTDPRRRSRNLGKVIDTLTCGFADLGPDQRPYCWHYPPKPCGIVPAKSVCGPVYCEECSQHLPYIEQGMMLAEQFKQKALGLLQTYQATVCARAQAPPPSWDQMWKCLIRLKPTLCGIVPAKSVCGPVYCFTPSPVVVGTTDRSGSSLTVTQLLRRLHQWISSECTTPCSGSWLRDLSDGSWSTVSSEAGTEDVVCCSMSYSWTGWDQMWKCLIRLKPTLHGPTPLLYRLGAVQNLAEQFKQKALGLLQTASRQAEVIAPAVQTNWQKLEVFWAKHMWNFISGIQYLAGLSTLPGLIAFASRGNHVSPTHYVPESDAAARVTAILATLCSALYVGDLCGSVFLVGQLFTFSPRRHSSVLCECYDAGCAWYELTPAETTVRLRAYMGWVAAQLAAPGAATAFVGAGLAGAAIGSVGSWHINSTALNCNESLNTGWLAGLFYQHKFNNALSNSLLRHHNLVYSTTSRSACQRQKKVTAAMSTNPKPQRKTKRNTNRRPQDVKFPGGGSQTKQSGENFPYLVAYQATVCARAQAPPPSAPTYSWGANDTDVFVLNNTRPPLGNWFGCTVPPPRKKRTVVLTESTLSTALAELATKSFGSTTSRSACQRQKKVTFDRLQVLDSHYQDVLDQAETAGARLVVLATATPPGSVTVPHPNIEFHYVTGMTTDNLKCPCQVPSPEFFTELDGVLKLTPIAAAGRLDLSGWFTAGYSGGDIYHSASRQAEVIAPAVQTNWQKLEVFWAKHMWNFCRASGVLTTSCGNTLTCYIKARAACRAAGLFDRLQVLDSHYQDVLKEVKAAASKVKANLLGPLTNSRGENCGYRRCRASGVLTTSCGNTLIMHTRCHCGAEITGHVKNGTMRIVGPRTCREVSFRVGLHEYPVGSQLPCEPEPDVAVLTSKEVKAAASKVKANLLSVEEACSLTPPHSAKGRDAVILLMCVVHPTLVFDITKLLLAVFGPMLTDPSHITAEAAGRRLARGSPPSMASSSASPRPISYLKGSSGGPLLCPAGHAVGIFRAADFDQGWGPISYANGSGPDQRPYCWHYPPKPRHVGPGEGAVQWMNRLIAFASRGNHVSPTHCLWMMLLISQAEAALENLVILNAASLAGTHIIPDREVLYREFDEMEECSQHLPYIEQGMMLIHLHQNIVDVQYLYGVGSSIASWAIKWEYVSHARPRWFWFCLLLLAAGVGIYLLPNRAAAATLGFGAYMSKAHGIDPNIRTGVRTITTGRVQGLLRICALARKMIGGHYVQMAIIKLGARRFAQALPVWARPDYNPPLVETWKKPDYEPTAAQTFLATCINGVCWTVYHGAGTRTIASPWAHNGLRDLAVAVEPVVFSQMETKLITWGAKGPVIQMYTNVDQDLVGWPAPQGSRSLTPCKVVILDSFDPLVAEEDEREISVPAEILRKSLTGTYVYNHLTPLRDWAHNGLRDLAVAVEPVCTRGVAKAVDFIPVENLETTMRSPVFTDNALGINAVAYYRGLDVSVIPTSGDVVVVATDMSADLEVVTSTWVLVGGVLAALAAYCLSTGALMTGYTGDFDSVIDCNTCVTQTVDFSLDPNTNRRPQDVKFPGGGQIVGGVYLLPRRGPRRALAHGVRVLEDGVNYATGNLPGCSFSIFLSKFGYGAKDVRCHARKAVAHINSVWKDLLETPGAKQNIQLINTNGSWHINSTALNCNESLNTGWLAGLFYQHKFNSSGCPERLASCRRLTVVLLFLLLADARVCSCLWMMLLISQAEAALDCEIYGACYSIEPLDLPPIIQRLHGLSAFSWTVYHGAGTRTIASPKGPVIQMYTNVDQDLYRFVAPGERPSGMFDSSVLCECYDAGCAWYRSELSPLLLSTTQWQVLPCSFTTLPALSTGLRKLGVPPLRAWRHRARSVRARLLARGGRASPLTTSQTLLFNILGGWVAAQLAAPGAATAVKNGTMRIVGPRTCRNMWSGTFPINAYTTGEVALSTTGEIPFYGKAIPLEVIKGGRHLIFLTRDPTTPLARAAWETARHTPVNSWLGNIIRVSAEEYVEIRRVGDFHYVTGMTTDNLKCPPVVHGCPLPPPRSPPVPPPRKKRTVVLTESTLSTALAELATKSFGSSSTSGITGDNTTTSVSCQRGYKGVWRGDGIMHTRCHCGAEITGHVFLVGQLFTFSPRRHWTTQGCNCSIYPGHIFVGAGLAGAAIGSVGLGKVLVDILAGYGAGDIWDWICEVLSDFKTWLKAKLMPQLPGIPFNSSIVYEAADAILHTPGCVPCVREGNASRCSSGCPERLASCRRLTDFDQGWGPISYANGSRTEEAIYQCCDLDPQARVAIKSLTERLYVGVSKGWRLLAPITAYAQQTRGLLGCIITSLTFFSVLIARDQLEQALDCEIYGACYSIEPLDCQVPSPEFFTELDGVRLHRFAPPCKPLLRETCYIKARAACRAAGLQDCTMLVCGDDLVVIIDPNIRTGVRTITTGSPITYSTYGKFLADGCNWTRGERCDLEDRDRSELSPLLLSTTQWQTGHRMAWDMMMNWSPTAALVMAQLLRIPQAPGALVVGVVCAAILRRHVGPGEGAVQWMNRHDSPDAELIEANLLWRQEMGGNITRVESENEGVFTGLTHIDAHFLSQTKQSGENFPYLVARGRRQPIPKARRPEGRTWAQPGYPWPLYGNLIVFPDLGVRVCEKMALYDVVSKLPLAVMGYATGNLPGCSFSIFLLALLSCLTVPASAYQLGKVLVDILAGYGAGVAGALVAFKIMSGEVSYSSMPPLEGEPGDPDLSDGSWSTVSSEAGRQEMGGNITRVESENKVVILDSFDPLVAEEVGWPAPQGSRSLTPCTCGSSDLYLVTRHADGCSGGAYDIIICDECHSTDATSILGIGTVLTFTIETTTLPQDAVSRTQRRGRTGRGKPGIDCFRKHPEATYSRCGSGPWITPRCLVDYPYLAAGVGIYLLPNRAAALVTPCAAEEQKLPINALSNSLLRHHNLVYISSECTTPCSGSWLRDIWDWICEVLSDFKTWLKAKLMPQLPGIPFVSCQRGYKGVWRGDGSGPWITPRCLVDYPYRLWHYPCTINYTIFK

SEQ ID NO: 811 - DNA, 6065 bp, Artificial
  HepC cassette A
  CDS (15)..(6047)
ggcggatccccaccatggtgattcccgtcaggagaaggggagactccaggggaagcctcctgtcccccagacccattagctatctgaaaggctccagcggaggccctgccagaaggggaagggaaatcctcctgggacccgctgacggaatggtcagcaaaggctggaggctcctggctcccattaccgcttacgctaggctccacagattcgctcccccttgcaaacccctcctgagagaggaagtgtccttcagagtgggactgcatgagtatcccgtcggctccgtggtcttctcccagatggagacaaagctcatcacatggggagccgataccgctgcctgtggcgatatcattaacggactgcctgtgtccctgctctgccctgccggacacgctgtgggaatctttagggctgccgtctgcacaaggggagtggctaaggctgtggatttcattcccgtctgcgtcgtgattgtgggaaggattgtgctcagcggaaagcctgccattatccctgacagagaggtcctgtatagggagtttgatgagatgccctgtacccctctgcctgcccctaactatacctttgccctctggagagtgtccgccgaagagtatgtggaaatcagaagggtcggcgatgccctctacgatgtggtcagcaaactgcctctggctgtgatgggctccagctatggctttcagtatagccctggccaaagggtcgagtttatctcctggtgtctgtggtggctccagtatttcctcaccagagtggaagcccaactgcatgtgtgggtgcctcccctcaacgtcaggggagagaatctggtcatcctcaacgctgcctccctggctggcacacacggactggtcagctttctggtcttcttttgctttgcctggtacctcctgcctcccattatccaaaggctccacggactgtccgcctttagcctccactcctactcccccggagagattaacagagtggctgcctgtaaccctcccctcgtggaaacctggaagaaacccgattacgaaccccctgtggtccacggatgccctctgcctccccctaggtccccccctggcgtcggctccagcattgcctcctgggctatcaaatgggaatacgtcgtgctcctgtttctgctcctggctgacgctagggtctgctccctgaataacacaaggcctcccctcggcaattggtttggctgtacctggatgaatagcacaggctttaccaaagtgtgtggcgctccccctttcacagaggctatgacaaggtatagcgctccccctggcgatccccctcagcctgagtatgacctcgagctcatcacaagctgtagctcctggcctctgctcctgctcctgctcgccctcccccaaagggcttacgctctggataccgaagtggctgcctcctgcggaggcgtcgtgctccagcaaaccagaggcctcctgggatgcattatcacaagcctcaccggaagggataagaatcaggtcgagggagaggtccagattgtgtccagctccccccctgccgtcccccaaagctttcaggtcgcccatctgcatgcccctaccggaagcggaaagtccaccaaagtgcctgccgctaacacacccggactgcctgtgtgtcaggatcacctcgagttttgggaaggcgtcttcacaggcctcacccatatcgatgcccatttcctcgtgctcctgctcttcgctggcgtggatgctgagacacacgtcaccggaggcaatgccggaaggacaacctccggcctcgtgtccctgctcgaggtcaccctcacccatcccgtcaccaaatacattatgacatgcatgagcgctgacctcgaggtcgtgacaagcacatgggtcctggtcgtgggactgatggccctcaccctcagcccttactataagagatacattagctggtgcctctggtggctgcaatactttctgacaagggtcgccatttgcggaaagtatctgtttaactgggccgtcaggacaaagctcaagctcacccctatcgctgccgctggcagactggatctgtccatcgcttactttagcatggtgggaaactgggccaaagtgctcgtggtcctgctcctgtttgccggagtggatgccgaaacccatgtgacaaggctcgccagaggctccccccctagcatggcctccagctccgcctcccagctcagcgctccctccctgaaagccacatgcacagccaatggcctcgtgtccttcctcgtgtttttctgtttcgcttggtatctgaaaggcagatgggtccccggagccgtctacgctctgtatggcatgcagctcccctgtgagcctgagcctgacgtcgccgtcctgacaagcatgctgacagaccctagccatatcacagccgaagccgctggcagagactccgtgacacccattgacacaaccattatggctaagaatgaggtcttctgtgtgcaacccgaaaagggaggcagaaagcctgccagatacgctgcccaaggctataaggtcctggtcctgaatccctccgtggctgccacactgggattcggagcctatatgtccaaggctcacggagtgagaaactccaccggactgtatcacgtcaccaatgactgtcccaatagctccatcgtctacgaagccgctgacgctatcctccacacaagctcctacggattccaatactcccccggacagagagtggagtttctcgtgcaagcctggaagtccaagaaaacccctatgggattctccgacacagccgcttgcggagacattatcaatggcctccccgtcagcgctaggagaggcagagagattctgctcggccctgccgatggcatgagccaactgtccgcccctagcctcaaggctacctgtaccgctaaccatgactcccccgatgccgaactgattgaggctaacctcctgtggaaccctgccattgcctccctgatggcctttaccgctgccgtcacctcccccctcaccacaagccaaaccctcctgtttaacattctgggactggtccaggcttggaaaagcaaaaagacacccatgggctttagctatgacacaaggtgtttcgatagcacagtgacagagtccgacattgacgaaagggaaatctccgtgcctgccgaaatcctcaggaaaagcagaaggtttgcccaagccctccccgtctgggctaggcctgactatatgtttgcccctaccctctgggctaggatgatcctcatgacacactttttctccgtgctcatcgctagggatcagctcgagcaagccctcagcgtcatccctacctccggcgatgtggtcgtggtcgccacagacgctctgatgaccggatacacaggcgatttcgatagcgtcatcgattgccatagcaaaaagaaatgcgatgagctcgccgctaagctcgtggctctgggaatcaatgccgtcgcctattacagaggcctcgacgtcgtgctcccctgtagctttaccacactgcctgccctcagcacaggcctcatccatctgcatcagaatatcgtggatgtccagtatctgtataagggaaggtgggtgcctggcgctgtgtatgccctctacggaatgtggcccctcctgctcctgctcctggctctgcctcagagagcctatagccctatcacatactccacctatggcaaattcctcgccgatggcggatgctccggcggagcctatgacattatcatttgcgatgagtgtgccagaagcgtcagggctaggctcctggctaggggaggcagagccgctatctgtggcaaatacctcttcaattgggctgtgagaaccaaaaaggctgtggctcacattaactccgtgtggaaggatctgctcgaggatagcgtcacccctatcgataccacaatcatggccaaaaacgagtttacaccctcccccgtcgtggtcggcacaaccgataggtccggcgctcccacatactcctggggagccaatgacacagacgtcttcgtccccggatgcgtcccctgtgtgagagagggaaacgctagcagatgctgggtggctatgacacccacagtggctaccagagacggaaagctccaggattgcacaatgctcgtgtgtggcgatgacctcgtggtcatctgtgagtccgccggagtgcaagaggatgccgctagcctcagggctgtggctggcgctctggtcgcctttaagattatgtccggcgaagtgcctagcacagaggatctggtcaacctcctgcctgccattctgtcctacgataccagatgctttgactccaccgtcaccgaaagcgatatcagaaccgaagaggctatctatcagtgttgcgatctcgacccccaagagctcacccctgccgaaaccacagtgagactgagagcctatatgaatacccctggcctccccgtctgccaagaccatctggagttttggccccaacccgaatacgatctggaactgattacctcctgctccagcaatgtgtccgtggctcacgatggcgctggcaaaagggtctactatctgggaaaggtcatcgataccctcacctgtggctttgccgatctgatgggctatatccctctggtcggcgctcccctcggcggagccgctgccattcccctcgaggtcatcaaaggcggaaggcatctgattttctgtcactccaagaaaaagtgtgacgaactggctgccaaactggtcggcggagtgctcgccgctctggctgcctattgcctcagcacaggctgtgtggtcatcgtcggcagaatcgtcctgtccggcaaacccgcttgcgaaagcgctggcgtccaggaagacgctgcctccctgagagcctttaccgaagccatgaccagatactccgcccctcccggagaccctggctggttcacagccggatactccggcggagacatttaccatagcgtcagccatgccagacccagatggttttggttttgcctcctgctcagctccagcacaagcggaatcacaggcgataacacaaccacaagctccgagcctgcccctagcggatgccctcccgatagcgatgccgaaaggacacagagaaggggaaggacaggcagaggcaaacccggaatctataggtttgtggctcccggagagagaccctccggcatgttcgatgtgagaatgtatgtgggaggcgtcgagcataggctcgaggctgcctgtaactggaccagaggcgaaaggtgtgacctcgaggatagggatgaggctcagctccacgtctgggtcccccctctgaatgtgagaggcggaagggatgccgtcatcctcctgatgtgcgtcgtgcatcccacactgggagtgagagccacaaggaaaacctccgagagaagccaacccagaggcagaaggcaacccattcccaaagccagaaggcctgagggaaacgtcagcgtcgcccatgacggagccggaaagagagtgtattacctcaccagagaccctaccacacccctcgccagagccgcttgggaaagcgaacccgctccctccggctgtccccctgactccgacgctgagtcctactccagcatgccccctctggaaggcgaacccggagaccctatcggaggccattacgtccagatggccattatcaaactgggagccctcaccggaacctatgtgtataaccatctgacacccctcagagacccctccaccgaagacctcgtgaatctgctccccgctatcctcagccctggcgctctggtcgtgggagtggtctgcgctgccattctgagaatcctcgacatgatcgctggcgctcactggggcgtcctggctggcattgcctatttctccatggtcggcaattgggctaaggtcctggtcgagggatgcggatgggctggctggctgctcagccctaggggaagcagaccctcctggggacccacagaccctaggagaaggtccaggaatgtcgactgagaattcgcc

SEQ ID NO: 812 - protein, 2011 aa, Artificial
  HepC cassette A
MVIPVRRRGDSRGSLLSPRPISYLKGSSGGPARRGREILLGPADGMVSKGWRLLAPITAYARLHRFAPPCKPLLREEVSFRVGLHEYPVGSVVFSQMETKLITWGADTAACGDIINGLPVSLLCPAGHAVGIFRAAVCTRGVAKAVDFIPVCVVIVGRIVLSGKPAIIPDREVLYREFDEMPCTPLPAPNYTFALWRVSAEEYVEIRRVGDALYDVVSKLPLAVMGSSYGFQYSPGQRVEFISWCLWWLQYFLTRVEAQLHVWVPPLNVRGENLVILNAASLAGTHGLVSFLVFFCFAWYLLPPIIQRLHGLSAFSLHSYSPGEINRVAACNPPLVETWKKPDYEPPVVHGCPLPPPRSPPGVGSSIASWAIKWEYVVLLFLLLADARVCSLNNTRPPLGNWFGCTWMNSTGFTKVCGAPPFTEAMTRYSAPPGDPPQPEYDLELITSCSSWPLLLLLLALPQRAYALDTEVAASCGGVVLQQTRGLLGCIITSLTGRDKNQVEGEVQIVSSSPPAVPQSFQVAHLHAPTGSGKSTKVPAANTPGLPVCQDHLEFWEGVFTGLTHIDAHFLVLLLFAGVDAETHVTGGNAGRTTSGLVSLLEVTLTHPVTKYIMTCMSADLEVVTSTWVLVVGLMALTLSPYYKRYISWCLWWLQYFLTRVAICGKYLFNWAVRTKLKLTPIAAAGRLDLSIAYFSMVGNWAKVLVVLLLFAGVDAETHVTRLARGSPPSMASSSASQLSAPSLKATCTANGLVSFLVFFCFAWYLKGRWVPGAVYALYGMQLPCEPEPDVAVLTSMLTDPSHITAEAAGRDSVTPIDTTIMAKNEVFCVQPEKGGRKPARYAAQGYKVLVLNPSVAATLGFGAYMSKAHGVRNSTGLYHVTNDCPNSSIVYEAADAILHTSSYGFQYSPGQRVEFLVQAWKSKKTPMGFSDTAACGDIINGLPVSARRGREILLGPADGMSQLSAPSLKATCTANHDSPDAELIEANLLWNPAIASLMAFTAAVTSPLTTSQTLLFNILGLVQAWKSKKTPMGFSYDTRCFDSTVTESDIDEREISVPAEILRKSRRFAQALPVWARPDYMFAPTLWARMILMTHFFSVLIARDQLEQALSVIPTSGDVVVVATDALMTGYTGDFDSVIDCHSKKKCDELAAKLVALGINAVAYYRGLDVVLPCSFTTLPALSTGLIHLHQNIVDVQYLYKGRWVPGAVYALYGMWPLLLLLLALPQRAYSPITYSTYGKFLADGGCSGGAYDIIICDECARSVRARLLARGGRAAICGKYLFNWAVRTKKAVAHINSVWKDLLEDSVTPIDTTIMAKNEFTPSPVVVGTTDRSGAPTYSWGANDTDVFVPGCVPCVREGNASRCWVAMTPTVATRDGKLQDCTMLVCGDDLVVICESAGVQEDAASLRAVAGALVAFKIMSGEVPSTEDLVNLLPAILSYDTRCFDSTVTESDIRTEEAIYQCCDLDPQELTPAETTVRLRAYMNTPGLPVCQDHLEFWPQPEYDLELITSCSSNVSVAHDGAGKRVYYLGKVIDTLTCGFADLMGYIPLVGAPLGGAAAIPLEVIKGGRHLIFCHSKKKCDELAAKLVGGVLAALAAYCLSTGCVVIVGRIVLSGKPACESAGVQEDAASLRAFTEAMTRYSAPPGDPGWFTAGYSGGDIYHSVSHARPRWFWFCLLLSSSTSGITGDNTTTSSEPAPSGCPPDSDAERTQRRGRTGRGKPGIYRFVAPGERPSGMFDVRMYVGGVEHRLEAACNWTRGERCDLEDRDEAQLHVWVPPLNVRGGRDAVILLMCVVHPTLGVRATRKTSERSQPRGRRQPIPKARRPEGNVSVAHDGAGKRVYYLTRDPTTPLARAAWESEPAPSGCPPDSDAESYSSMPPLEGEPGDPIGGHYVQMAIIKLGALTGTYVYNHLTPLRDPSTEDLVNLLPAILSPGALVVGVVCAAILRILDMIAGAHWGVLAGIAYFSMVGNWAKVLVEGCGWAGWLLSPRGSRPSWGPTDPRRRSRN

SEQ ID NO: 813 - DNA, 6069 bp, Artificial
  HepC cassette B
  CDS (22)..(6051)
ggcggatccaccatgctcgagtggacaacccaaggctgtaactgtagcatttaccctggccatatcacaggccataggatggcctgggacatgatgatgaactggagcccttgggtcgccatgacccctaccgtcgccacaagggatggcaaactgcctgccacacagctcaggagacacattgacctcctggtcggctccaggctctggcattacccttgcacaatcaattacacaatctttaaggtcaggatgtacgtcggcggagtggaacacagactggaagccgctgtgttttgcgtccagcctgagaaaggcggaaggaaacccgctaggctcatcgtcttccctgacctcggcgtcagggtctgcgaaaagatgatgggatacattcccctcgtgggagcccctctgggaggcgctgccagagccctcgcccatggcgtcagggtcctggaagacggagtgaatggcggaaacgctggcagaaccacaagcggactggtcagcctcctgacacccggagccaaacagaatatccaactgattaacacaaacggactggctctgctcagctgtctgacagtgcctgcctccgcctatcaggtcaggaatagcacaggcctctaccatgtgacaaacgattgccctggcagagacaaaaaccaagtggaaggcgaagtgcaaatcgtcagcacagccgctcagacattcctcgccacatgcattaacggagtgtgtcccgctacccaactgagaaggcatatcgatctgctcgtgggaagcgctaccctctgctccgccctctacgtcggcgatctgtgtggctcccacgctcccacaggctccggcaaaagcacaaaggtccccgctgcctatgccgctcagggatacaaagtgctcgtgctcaaccctagcgtcaggacatgggctcagcctggctatccctggcccctctacggaaacgaaggctgtggctgggccggatggctcctgtcccccagaggctccaccgaagacgtcgtgtgttgctccatgtcctactcctggacaggcgctctggtcaccccttgcgctgccgaagagcaaaagctccccattgccctcgacacagaggtcgccgctagctgtggcggagtggtcctggtcggcctcatggctctgacactgtccccctattacaaaaggtattggatgaactccaccggattcacaaaggtctgcggagcccctccctgtgtgattggcggagccggaaacaataccctccactgtcccacaagcgtcgaggaagcctgtagcctcacccctccccatagcgctaagtccaagtttggctatggcgctaaggatgtgagatgccatgccagaatctccggcattcagtatctggctggcctcagcacactgcctggcaatcccgctatcgctagcctcatggctttcacagccgctgtgacacagattgtgggaggcgtctacctcctgcctaggagaggccctaggctcggcgtcagggctaccagaaagacaagcgaaaggtcccagcctctgcatagctatagccctggcgaaatcaatagggtcgccgcttgcctcaggaaactgggagtgcctcccctcagggcttggagacacagaaccgctaggcatacccctgtgaatagctggctgggaaacattatcatgttcgctcccacactgtgggccagaatgattctgatgacccatgagaatctggaaaccacaatgagaagccctgtgtttaccgataactccagccctcccgctgtgcctcagtccttccaagtggctcacctcgccacaccccctggctccgtgacagtgcctcaccctaacattgaggaagtggctctgtccaccacaggcgaaatccctttctatggcaaactggtcttcgatatcacaaagctcctgctcgccgtcttcggacccctctggattctgcaagcctccctgctcaaggtcccctatttcgtcaccgctgccctcgtgatggcccaactgctcaggattccccaagccattctggatatgattgccggagcccattggggagtgctcgccggatgcaatacctgtgtgacacagacagtggatttctccctcgaccccacattcacaatcgaaaccacaaccctcccccaagacgctgtgtcccacggacccacacccctcctgtataggctcggcgctgtgcaaaacgaagtgacactgacacaccctgtgacaaagtatatcatgacctgtgccagagtggctatcaaaagcctcaccgaaaggctctacgtcggcggacccctcaccaatagcagaggcgaaaactgtggctataggagatgcgtcatcggaggcgctggcaataacacactgcattgccctaccgattgctttaggaaacaccctgaggctacctatagcagatgcggaacctgtggctccagcgatctgtatctggtcaccagacacgctgacgtcatccctgtgagaaggagaggcgatagcagaggctccctgctcaacatgtggtccggcacattccctatcaatgcctataccacaggcccttgcacacccctccccgctcccaattacacattcgctctgtggcactccaccgatgccacaagcattctgggaatcggaaccgtcctggatcaggctgagacagccggagccagactggtcgtgctcgccacatacgtccccgaaagcgatgccgctgccagagtgacagccattctgtccagcctcaccgtcacccaactgctcaggagactgcatcagtggaggcctagctggggccctaccgatcccagaaggagaagcagaaacctcggcaaagtgattgacacactgacatgcggattcgctgacctcggccctgaccaaaggccttactgttggcattaccctcccaaaccctgtggcattgtgcctgccaaaagcgtctgcggacccgtctactgtgaggaatgctcccagcatctgccttacattgagcaaggcatgatgctcgccgaacagtttaagcaaaaggctctgggactgctccagacataccaagccacagtgtgtgccagagcccaagcccctccccctagctgggaccaaatgtggaagtgtctgattaggctcaagcctaccctctgcggaatcgtccccgctaagtccgtgtgtggccctgtgtattgctttacccctagccctgtggtcgtgggaaccacagacagaagcggaagctccctgacagtgacacagctcctgagaaggctccaccaatggattagctccgagtgtaccacaccctgtagcggaagctggctgagagacctcagcgatggctcctggtccaccgtcagctccgaggctggcacagaggatgtggtctgctgtagcatgagctatagctggaccggatgggatcagatgtggaaatgcctcatcagactgaaacccacactgcatggccctacccctctgctctacagactgggagccgtccagaatctggctgagcaattcaaacagaaagccctcggcctcctgcaaaccgctagcagacaggctgaggtcatcgctcccgctgtgcaaaccaattggcaaaagctcgaggtcttctgggccaaacacatgtggaatttcattagcggaatccaatacctcgccggactgtccaccctccccggactgattgcctttgcctccaggggaaaccatgtgtcccccacacactatgtgcctgagtccgacgctgccgctagggtcaccgctatcctcgccacactgtgtagcgctctgtatgtgggagacctctgcggaagcgtcttcctcgtgggacagctcttcacattctcccccagaaggcatagctccgtgctctgcgaatgctatgacgctggctgtgcctggtacgaactgacacccgctgagacaaccgtcaggctcagggcttacatgggctgggtggctgcccaactggctgcccctggcgctgccacagcctttgtgggagccggactggctggcgctgccattggctccgtgggaagctggcacattaactccaccgctctgaattgcaatgagtccctgaataccggatggctcgccggactgttttaccaacacaaattcaataacgctctgtccaactccctgctcaggcatcacaatctggtctactccaccacaagcagaagcgcttgccaaaggcaaaagaaagtgacagccgctatgtccaccaatcccaaaccccaaaggaaaaccaaaaggaataccaataggagaccccaagacgtcaagtttcccggaggcggaagccaaaccaaacagtccggcgaaaactttccctatctggtcgcctatcaggctaccgtctgcgctagggctcaggctccccctccctccgcccctacctatagctggggcgctaacgataccgatgtgtttgtgctcaacaataccagaccccctctgggaaactggttcggatgcacagtgcctccccctaggaaaaagagaaccgtcgtgctcaccgaaagcacactgtccaccgctctggctgagctcgccacaaagtccttcggaagcacaacctccaggtccgcctgtcagagacagaaaaaggtcacctttgacagactgcaagtgctcgactcccactatcaggatgtgctcgaccaagccgaaaccgctggcgctaggctcgtggtcctggctaccgctacccctcccggaagcgtcaccgtcccccatcccaatatcgagtttcattacgtcaccggaatgacaaccgataacctcaagtgtccctgtcaggtcccctcccccgagttttttaccgaactggatggcgtcctgaaactgacacccattgccgctgccggaaggctcgacctcagcggatggtttaccgctggctatagcggaggcgatatctatcactccgcctccaggcaagccgaagtgattgcccctgccgtccagacaaactggcagaaactggaagtgttttgggctaagcatatgtggaacttttgcagagcctccggcgtcctgacaacctcctgcggaaacacactgacatgctatatcaaagccagagccgcttgcagagccgctggcctcttcgataggctccaggtcctggatagccattaccaagacgtcctgaaagaggtcaaggctgccgctagcaaagtgaaagccaatctgctcggccctctgacaaactccaggggagagaattgcggatacagaaggtgtagggctagcggagtgctcaccacaagctgtggcaataccctcatcatgcacacaaggtgtcactgtggcgctgagattaccggacacgtcaagaatggcacaatgagaatcgtcggccctaggacatgcagagaggtcagctttagggtcggcctccacgaataccctgtgggaagccaactgccttgcgaacccgaacccgatgtggctgtgctcacctccaaggaagtgaaagccgctgcctccaaggtcaaggctaacctcctgtccgtggaagaggcttgctccctgacaccccctcactccgccaaaggcagagacgctgtgattctgctcatgtgtgtggtccaccctaccctcgtgtttgacattaccaaactgctcctggctgtgtttggccctatgctcaccgatccctcccacattaccgctgaggctgccggaaggagactggctaggggaagccctccctccatggctagctccagcgctagccctaggcctatctcctacctcaagggaagctccggcggacccctcctgtgtcccgctggccatgccgtcggcattttcagagccgctgactttgaccaaggctggggccctatctcctacgctaacggaagcggacccgatcagagaccctattgctggcactatccccctaagcctaggcatgtgggacccggagagggagccgtccagtggatgaataggctcatcgctttcgctagcagaggcaatcacgtcagccctacccatctcgagtgagaattcgcc

SEQ ID NO: 814 - protein, 2010 aa, Artificial
  HepC cassette B
WTTQGCNCSIYPGHITGHRMAWDMMMNWSPWVAMTPTVATRDGKLPATQLRRHIDLLVGSRLWHYPCTINYTIFKVRMYVGGVEHRLEAAVFCVQPEKGGRKPARLIVFPDLGVRVCEKMMGYIPLVGAPLGGAARALAHGVRVLEDGVNGGNAGRTTSGLVSLLTPGAKQNIQLINTNGLALLSCLTVPASAYQVRNSTGLYHVTNDCPGRDKNQVEGEVQIVSTAAQTFLATCINGVCPATQLRRHIDLLVGSATLCSALYVGDLCGSHAPTGSGKSTKVPAAYAAQGYKVLVLNPSVRTWAQPGYPWPLYGNEGCGWAGWLLSPRGSTEDVVCCSMSYSWTGALVTPCAAEEQKLPIALDTEVAASCGGVVLVGLMALTLSPYYKRYWMNSTGFTKVCGAPPCVIGGAGNNTLHCPTSVEEACSLTPPHSAKSKFGYGAKDVRCHARISGIQYLAGLSTLPGNPAIASLMAFTAAVTQIVGGVYLLPRRGPRLGVRATRKTSERSQPLHSYSPGEINRVAACLRKLGVPPLRAWRHRTARHTPVNSWLGNIIMFAPTLWARMILMTHENLETTMRSPVFTDNSSPPAVPQSFQVAHLATPPGSVTVPHPNIEEVALSTTGEIPFYGKLVFDITKLLLAVFGPLWILQASLLKVPYFVTAALVMAQLLRIPQAILDMIAGAHWGVLAGCNTCVTQTVDFSLDPTFTIETTTLPQDAVSHGPTPLLYRLGAVQNEVTLTHPVTKYIMTCARVAIKSLTERLYVGGPLTNSRGENCGYRRCVIGGAGNNTLHCPTDCFRKHPEATYSRCGTCGSSDLYLVTRHADVIPVRRRGDSRGSLLNMWSGTFPINAYTTGPCTPLPAPNYTFALWHSTDATSILGIGTVLDQAETAGARLVVLATYVPESDAAARVTAILSSLTVTQLLRRLHQWRPSWGPTDPRRRSRNLGKVIDTLTCGFADLGPDQRPYCWHYPPKPCGIVPAKSVCGPVYCEECSQHLPYIEQGMMLAEQFKQKALGLLQTYQATVCARAQAPPPSWDQMWKCLIRLKPTLCGIVPAKSVCGPVYCFTPSPVVVGTTDRSGSSLTVTQLLRRLHQWISSECTTPCSGSWLRDLSDGSWSTVSSEAGTEDVVCCSMSYSWTGWDQMWKCLIRLKPTLHGPTPLLYRLGAVQNLAEQFKQKALGLLQTASRQAEVIAPAVQTNWQKLEVFWAKHMWNFISGIQYLAGLSTLPGLIAFASRGNHVSPTHYVPESDAAARVTAILATLCSALYVGDLCGSVFLVGQLFTFSPRRHSSVLCECYDAGCAWYELTPAETTVRLRAYMGWVAAQLAAPGAATAFVGAGLAGAAIGSVGSWHINSTALNCNESLNTGWLAGLFYQHKFNNALSNSLLRHHNLVYSTTSRSACQRQKKVTAAMSTNPKPQRKTKRNTNRRPQDVKFPGGGSQTKQSGENFPYLVAYQATVCARAQAPPPSAPTYSWGANDTDVFVLNNTRPPLGNWFGCTVPPPRKKRTVVLTESTLSTALAELATKSFGSTTSRSACQRQKKVTFDRLQVLDSHYQDVLDQAETAGARLVVLATATPPGSVTVPHPNIEFHYVTGMTTDNLKCPCQVPSPEFFTELDGVLKLTPIAAAGRLDLSGWFTAGYSGGDIYHSASRQAEVIAPAVQTNWQKLEVFWAKHMWNFCRASGVLTTSCGNTLTCYIKARAACRAAGLFDRLQVLDSHYQDVLKEVKAAASKVKANLLGPLTNSRGENCGYRRCRASGVLTTSCGNTLIMHTRCHCGAEITGHVKNGTMRIVGPRTCREVSFRVGLHEYPVGSQLPCEPEPDVAVLTSKEVKAAASKVKANLLSVEEACSLTPPHSAKGRDAVILLMCVVHPTLVFDITKLLLAVFGPMLTDPSHITAEAAGRRLARGSPPSMASSSASPRPISYLKGSSGGPLLCPAGHAVGIFRAADFDQGWGPISYANGSGPDQRPYCWHYPPKPRHVGPGEGAVQWMNRLIAFASRGNHVSPTH

SEQ ID NO: 815 - DNA, 6030 bp, Artificial
  HepC cassette C
  CDS (22)..(6012)
ggcggatccaccatgctcgagtgcctctggatgatgctcctgattagccaagccgaagccgctctggaaaacctcgtgattctgaatgccgctagcctcgccggaacccatatcattcccgatagggaagtgctctacagagagtttgacgaaatggaagagtgtagccaacacctcccctatatcgaacagggaatgatgctgattcacctccaccaaaacattgtggatgtgcaatacctctacggagtgggaagctccatcgctagctgggccattaagtgggagtatgtgtcccacgctaggcctaggtggttctggttctgtctgctcctgctcgccgctggcgtcggcatttacctcctgcctaacagagccgctgccgctaccctcggctttggcgcttacatgagcaaagcccatggcattgaccctaacattaggacaggcgtcaggacaatcacaaccggaagggtccagggactgctcaggatttgcgctctggctaggaaaatgattggcggacactatgtgcaaatggctatcattaagctcggcgctaggagattcgctcaggctctgcctgtgtgggccagacccgattacaatccccctctggtcgagacatggaaaaagcctgactatgagcctaccgctgcccaaacctttctggctacctgtatcaatggcgtctgctggaccgtctaccatggcgctggcacaaggacaatcgctagcccttgggctcacaatggcctcagggatctggctgtggctgtggaacccgtcgtgtttagccaaatggaaaccaaactgattacctggggcgctaagggacccgtcatccaaatgtataccaatgtggatcaggatctggtcggctggcccgctccccaaggctccaggtccctgacaccctgtaaggtcgtgattctggatagctttgaccctctggtcgccgaagaggatgagagagagattagcgtccccgctgagattctgagaaagtccctgacaggcacatacgtctacaatcacctcacccctctgagagactgggcccataacggactgagagacctcgccgtcgccgtcgagcctgtgtgtaccagaggcgtcgccaaagccgtggattttatccctgtggaaaacctcgagacaaccatgaggtcccccgtcttcacagacaatgccctcggcattaacgctgtggcttactataggggactggatgtgtccgtgattcccacaagcggagacgtcgtggtcgtggctaccgatatgtccgccgatctggaagtggtcacctccacctgggtgctcgtgggaggcgtcctggctgccctcgccgcttactgtctgtccaccggagccctcatgacaggctataccggagactttgactccgtgattgactgtaacacatgcgtcacccaaaccgtggattttagcctcgaccctaacacaaacagaaggcctcaggatgtgaaattccctggcggaggccaaatcgtcggcggagtgtatctgctccccagaaggggacccagaagggctctggctcacggagtgagagtgctcgaggatggcgtcaactatgccacaggcaatctgcctggctgtagctttagcattttcctcagcaaattcggatacggagccaaagacgtcaggtgtcacgctaggaaagccgtcgcccatatcaatagcgtctggaaagacctcctggaaacccctggcgctaagcaaaacattcagctcatcaataccaatggctcctggcatatcaatagcacagccctcaactgtaacgaaagcctcaacacaggctggctggctggcctcttctatcagcataagtttaactccagcggatgccctgagagactggctagctgtaggagactgacagtggtcctgctcttcctcctgctcgccgatgccagagtgtgtagctgtctgtggatgatgctgctcatctcccaggctgaggctgccctcgactgtgagatttacggagcctgttactccatcgaacccctcgacctcccccctatcattcagagactgcatggcctcagcgctttctcctggacagtgtatcacggagccggaaccagaaccattgcctcccccaaaggccctgtgattcagatgtacacaaacgtggatcaagacctctacagattcgtcgcccctggcgaaaggcctagcggaatgtttgactccagcgtcctgtgtgagtgttacgatgccggatgcgcttggtataggtccgagctcagccctctgctcctgtccaccacacagtggcaggtcctgccttgctccttcacaaccctccccgctctgtccaccggactgagaaagctcggcgtcccccctctgagagcctggaggcatagggctaggtccgtgagagccagactgctcgccagaggcggaagggctagccctctgacaacctcccagacactgctcttcaatatcctcggcggatgggtcgccgctcagctcgccgctcccggagccgctaccgctctgtggattctccaggctagcctcctgaaagtgccttactttgtgagagtgcaaggcctcctgagaatctgtgccctcgccagaaagatggtgaaaaacggaaccatgaggattgtgggacccagaacctgtaggaatatgtggagcggaacctttcccattaacgcttacacaaccggagaggtcgccctcagcacaaccggagagattcccttttacggaaaggctatccctctggaagtgattaagggaggcagacacctcatctttctgacaagagaccccacaacccctctggctagggctgcctgggagacagccagacacacacccgtcaactcctggctcggcaatatcattagggtcagcgctgaggaatacgtcgagattaggagagtgggagactttcactatgtgacaggcatgaccacagacaatctgaaatgccctcccgtcgtgcatggctgtcccctcccccctcccagaagccctcccgtcccccctcccagaaagaaaaggacagtggtcctgacagagtccaccctcagcacagccctcgccgaactggctaccaaaagctttggctccagctccacctccggcattaccggagacaataccacaacctccgtgtcctgccaaaggggatacaaaggcgtctggagaggcgatggcattatgcataccagatgccattgcggagccgaaatcacaggccatgtgtttctggtcggccaactgtttacctttagccctaggagacactggaccacacagggatgcaattgctccatctatcccggacacattttcgtcggcgctggcctcgccggagccgctatcggaagcgtcggcctcggcaaagtgctcgtggatatcctcgccggatacggagccggagacatttgggattggatttgcgaagtgctcagcgatttcaaaacctggctgaaagccaaactgatgccccaactgcctggcattccctttaactccagcattgtgtatgaggctgccgatgccattctgcatacccctggctgtgtgccttgcgtcagggaaggcaatgcctccaggtgtagctccggctgtcccgaaaggctcgcctcctgcagaaggctcaccgatttcgatcagggatggggacccattagctatgccaatggctccaggacagaggaagccatttaccaatgctgtgacctcgaccctcaggctagggtcgccattaagtccctgacagagagactgtatgtgggagtgtccaagggatggagactgctcgcccctatcacagcctatgcccaacagacaaggggactgctcggctgtatcattacctccctgacattctttagcgtcctgattgccagagaccaactggaacaggctctggattgcgaaatctatggcgcttgctatagcattgagcctctggattgccaagtgcctagccctgagtttttcacagagctcgacggagtgagactgcataggtttgcccctccctgtaagcctctgctcagggaaacctgttacattaaggctagggctgcctgtagggctgccggactgcaagactgtaccatgctggtctgcggagacgatctggtcgtgattatcgatcccaatatcagaaccggagtgagaaccattaccacaggctcccccattacctatagcacatacggaaagtttctggctgacggatgcaattggacaaggggagagagatgcgatctggaagacagagacagaagcgaactgtcccccctcctgctcagcacaacccaatggcaaaccggacacagaatggcttgggatatgatgatgaattggtcccccacagccgctctggtcatggctcagctcctgagaatccctcaggctcccggagccctcgtggtcggcgtcgtgtgtgccgctatcctcaggagacacgtcggccctggcgaaggcgctgtgcaatggatgaacagacacgatagccctgacgctgagctcatcgaagccaatctgctctggagacaggaaatgggaggcaatatcacaagggtcgagtccgagaatgagggagtgtttaccggactgacacacattgacgctcactttctgtcccagacaaagcaaagcggagagaatttcccttacctcgtggctaggggaaggagacagcctatccctaaggctaggagacccgaaggcagaacctgggcccaacccggatacccttggcctctgtatggcaatctgattgtgtttcccgatctgggagtgagagtgtgtgagaaaatggctctgtatgacgtcgtgtccaagctccccctcgccgtcatgggatacgctaccggaaacctccccggatgctccttctccatctttctgctcgccctcctgtcctgcctcaccgtccccgctagcgcttaccaactgggaaaggtcctggtggatattctggctggctatggcgctggcgtcgccggagccctcgtggctttcaaaatcatgagcggagaggtcagctatagctccatgcctcccctcgagggagagcctggcgatcccgatctgtccgacggaagctggagcacagtgtccagcgaagccggaaggcaagagatgggcggaaacattaccagagtggaaagcgaaaacaaagtggtcatcctcgactccttcgatcccctcgtggctgaggaagtgggatggcctgcccctcagggaagcagaagcctcaccccttgcacatgcggaagctccgacctctacctcgtgacaaggcatgccgatggctgtagcggaggcgcttacgatatcattatctgtgacgaatgccatagcacagacgctacctccatcctcggcattggcacagtgctcacctttaccattgagacaaccacactgcctcaggatgccgtcagcagaacccaaaggagaggcagaaccggaaggggaaagcctggcattgactgtttcagaaagcatcccgaagccacatactccaggtgtggctccggcccttggattacccctaggtgtctggtggattatccctatctggctgccggagtgggaatctatctgctccccaatagggctgccgccctcgtgacaccctgtgccgctgaggaacagaaactgcctatcaatgccctcagcaatagcctcctgagacaccataacctcgtgtatatctccagcgaatgcacaaccccttgctccggctcctggctcagggatatctgggactggatctgtgaggtcctgtccgactttaagacatggctcaaggctaagctcatgcctcagctccccggaatccctttcgtcagctgtcagagaggctataagggagtgtggaggggagacggaagcggaccctggatcacacccagatgcctcgtggattacccttacagactgtggcactatccctgtaccattaactataccattttcaaaagatcttgagtcgacgaattcgcc

SEQ ID NO: 816 - protein, 1997 aa, Artificial
  HepC cassette C
CLWMMLLISQAEAALENLVILNAASLAGTHIIPDREVLYREFDEMEECSQHLPYIEQGMMLIHLHQNIVDVQYLYGVGSSIASWAIKWEYVSHARPRWFWFCLLLLAAGVGIYLLPNRAAAATLGFGAYMSKAHGIDPNIRTGVRTITTGRVQGLLRICALARKMIGGHYVQMAIIKLGARRFAQALPVWARPDYNPPLVETWKKPDYEPTAAQTFLATCINGVCWTVYHGAGTRTIASPWAHNGLRDLAVAVEPVVFSQMETKLITWGAKGPVIQMYTNVDQDLVGWPAPQGSRSLTPCKVVILDSFDPLVAEEDEREISVPAEILRKSLTGTYVYNHLTPLRDWAHNGLRDLAVAVEPVCTRGVAKAVDFIPVENLETTMRSPVFTDNALGINAVAYYRGLDVSVIPTSGDVVVVATDMSADLEVVTSTWVLVGGVLAALAAYCLSTGALMTGYTGDFDSVIDCNTCVTQTVDFSLDPNTNRRPQDVKFPGGGQIVGGVYLLPRRGPRRALAHGVRVLEDGVNYATGNLPGCSFSIFLSKFGYGAKDVRCHARKAVAHINSVWKDLLETPGAKQNIQLINTNGSWHINSTALNCNESLNTGWLAGLFYQHKFNSSGCPERLASCRRLTVVLLFLLLADARVCSCLWMMLLISQAEAALDCEIYGACYSIEPLDLPPIIQRLHGLSAFSWTVYHGAGTRTIASPKGPVIQMYTNVDQDLYRFVAPGERPSGMFDSSVLCECYDAGCAWYRSELSPLLLSTTQWQVLPCSFTTLPALSTGLRKLGVPPLRAWRHRARSVRARLLARGGRASPLTTSQTLLFNILGGWVAAQLAAPGAATALWILQASLLKVPYFVRVQGLLRICALARKMVKNGTMRIVGPRTCRNMWSGTFPINAYTTGEVALSTTGEIPFYGKAIPLEVIKGGRHLIFLTRDPTTPLARAAWETARHTPVNSWLGNIIRVSAEEYVEIRRVGDFHYVTGMTTDNLKCPPVVHGCPLPPPRSPPVPPPRKKRTVVLTESTLSTALAELATKSFGSSSTSGITGDNTTTSVSCQRGYKGVWRGDGIMHTRCHCGAEITGHVFLVGQLFTFSPRRHWTTQGCNCSIYPGHIFVGAGLAGAAIGSVGLGKVLVDILAGYGAGDIWDWICEVLSDFKTWLKAKLMPQLPGIPFNSSIVYEAADAILHTPGCVPCVREGNASRCSSGCPERLASCRRLTDFDQGWGPISYANGSRTEEAIYQCCDLDPQARVAIKSLTERLYVGVSKGWRLLAPITAYAQQTRGLLGCIITSLTFFSVLIARDQLEQALDCEIYGACYSIEPLDCQVPSPEFFTELDGVRLHRFAPPCKPLLRETCYIKARAACRAAGLQDCTMLVCGDDLVVIIDPNIRTGVRTITTGSPITYSTYGKFLADGCNWTRGERCDLEDRDRSELSPLLLSTTQWQTGHRMAWDMMMNWSPTAALVMAQLLRIPQAPGALVVGVVCAAILRRHVGPGEGAVQWMNRHDSPDAELIEANLLWRQEMGGNITRVESENEGVFTGLTHIDAHFLSQTKQSGENFPYLVARGRRQPIPKARRPEGRTWAQPGYPWPLYGNLIVFPDLGVRVCEKMALYDVVSKLPLAVMGYATGNLPGCSFSIFLLALLSCLTVPASAYQLGKVLVDILAGYGAGVAGALVAFKIMSGEVSYSSMPPLEGEPGDPDLSDGSWSTVSSEAGRQEMGGNITRVESENKVVILDSFDPLVAEEVGWPAPQGSRSLTPCTCGSSDLYLVTRHADGCSGGAYDIIICDECHSTDATSILGIGTVLTFTIETTTLPQDAVSRTQRRGRTGRGKPGIDCFRKHPEATYSRCGSGPWITPRCLVDYPYLAAGVGIYLLPNRAAALVTPCAAEEQKLPINALSNSLLRHHNLVYISSECTTPCSGSWLRDIWDWICEVLSDFKTWLKAKLMPQLPGIPFVSCQRGYKGVWRGDGSGPWITPRCLVDYPYRLWHYPCTINYTIFKRS

SEQ ID NO: 817 - protein, 661 aa, Artificial
  gp100 consensus polypeptide
MDLVLKRCLLHLAVIGALLAVGATKVPRNQDWLGVSRQLRTKAWNRQLYPEWTEAQRLDCWRGGQVSLKVSNDGPTLIGANASFSIALNFPGSQKVLPDGQVIWVNNTIINGSQVWGGQPVYPQETDDACIFPDGGPCPSGSWSQKRSFVYVWKTWGQYWQVLGGPVSGLSIGTGRAMLGTHTMEVTVYHRRGSRSYVPLAHSSSAFTITDQVPFSVSVSQLRALDGGNKHFLRNQPLTFALQLHDPSGYLAEADLSYTWDFGDSSGTLISRALVVTHTYLEPGPVTAQVVLQAAIPLTSCGSSPVPGTTDGHRPTAEAPNTTAGQVPTTEVVGTTPGQAPTAEPSGTTSVQVPTTEVISTAPVQMPTAESTGMTPEKVPVSEVMGTTLAEMSTPEATGMTPAEVSIVVLSGTTAAQVTTTEWVETTARELPIPEPEGPDASSIMSTESITGSLGPLLDGTATLRLVKRQVPLDCVLYRYGSFSVTLDIVQGIESAEILQAVPSGEGDAFELTVSCQGGLPKEACMEISSPGCQPPAQRLCQPVLPSPACQLVLHQILKGGSGTYCLNVSLADTNSLAVVSTQLIMPGQEAGLGQVPLIVGILLVLMAVVLASLIYRRRLMKQDFSVPQLPHSSSHWLRLPRIFCSCPIGENSPLLSGQQV

SEQ ID NO: 818 - protein, 118 aa, Artificial
  MART consensus polypeptide
MPREDAHFIYGYPKKGHGHSYTTAEEAAGIGILTVILGVLLLIGCWYCRRRNGYRALMDKSLHVGTQCALTRRCPQEGFDHRDSKVSLQEKNCEPVVPNAPPAYEKLSAEQSPPPYSP

SEQ ID NO: 819 - protein, 248 aa, Artificial
  TRP-1 consensus polypeptide
PAFLTWHRYHLLRLEKDMQEMLQEPSFSLPYWNFATGKNVCDICTDDLMGSRSNFDSTLISPNSVFSQWRVVCDSLEDYDTLGTLCNSTEDGPIRRNPAGNVARPMVQRLPEPQDVAQCLEVGLFDTPPFYSNSTNSFRNTVEGYSDPTGKYDPAVRSLHNLAHLFLNGTGGQTHLSSQDPIFVLLHTFTDAVFDEWLRRYNADISTFPLENAPIGHNRQYNMVPFWPPVTNTEMFVTAPDNLGYTYE

SEQ ID NO: 820 - protein, 529 aa, Artificial [sequence omitted]

SEQ ID NO: 821 - protein, 519 aa, Artificial
  TRP2 consensus polypeptide
MSPLWWGFLLSCLGCKILPGAQGQFPRVCMTVDSLVNKECCPRLGAESANVCGSQQGRGQCTEVRADTRPWSGPYILRNQDDRELWPRKFFHRTCKCTGNFAGYNCGDCKFGWTGPNCERKKPPVIRQNIHSLSPQEREQFLGALDLAKKRVHPDYVITTQHWLGLLGPNGTQPQFANCSVYDFFVWLHYYSVRDTLLGPGRPYRAIDFSHQGPAFVTWHRYHLLCLERDLQRLIGNESFALPYWNFATGRNECDVCTDQLFGAARPDDPTLISRNSRFSSWETVCDSLDDYNHLVTLCNGTYEGLLRRNQMGRNSMKLPTLKDIRDCLSLQKFDNPPFFQNSTFSFRNALEGFDKADGTLDSQVMSLHNLVHSFLNGTNALPHSAANDPIFVVLHSFTDAIFDEWMKRFNPPADAWPQELAPIGHNRMYNMVPFFPPVTNEELFLTSDQLGYSYAIDLPVSVEETPGWPTTLLVVMGTLVALVGLFVLLAFLQYRRLRKGYTPLMETHLSSKRYTEEA

SEQ ID NO: 822 - protein, 317 aa, Artificial [sequence omitted]

SEQ ID NO: 823 - protein, 125 aa, Artificial
  MUC1F consensus polypeptide
MTPGTQSPFFLLLLLTVLTVVTGSGHASSTPGGEKETSATQRSSVPSSTEKNAVSMTSSVLSSHSPGSGSSTTQGQDVTLAPATEPASGSAATWGQDVTSVPVTRPALGSTTPPAHDVTSAPDNK

SEQ ID NO: 824 - protein, 312 aa, Artificial
  MUC1R consensus polypeptide
NRPALGSTAPPVHNVTSASGSASGSASTLVHNGTSARATTTPASKSTPFSIPSHHSDTPTTLASHSTKTDASSTHHSSVPPLTSSNHSTSPQLSTGVSFFFLSFHISNLQFNSSLEDPSTDYYQELQRDISEMFLQIYKQGGFLGLSNIKFRPGSVVVQLTLAFREGTINVHDVETQFNQYKTEAASRYNLTISDVSVSDVPFPFSAQSGAGVPGWGIALLVLVCVLVALAIVYLIALAVCQCRRKNYGQLDIFPARDTYHPMSEYPTYHTHGRYVPPSSTDRSPYEKVSAGNGGSSLSYTNPAVAAASANL

SEQ ID NO: 825 - protein, 43 aa, Artificial
  BAGE consensus polypeptide
MAARAVFLALSAQLLQARLMKEESPVVSWRLEPEDGTALCFIF

SEQ ID NO: 826 - protein, 138 aa, Artificial
  GAGE-1 consensus polypeptide
MSWRGRSTYRPRPRRYVEPPEMIGPMRPEQFSDEVEPATPEEGEPATQRQDPAAAQEGEDEGASAGQGPKPEADSQEQGHPQTGCECEDGPDGQEMDPPNPEEVKTPEEEMRSHYVAQTGILWLLMNNCFLNLSPRKP

SEQ ID NO: 827 - protein, 51 aa, Artificial
  gp100ln4 consensus polypeptide
SWSQKRSFVYVWKTWGEGLPSQPIIHTCVYFFLPDHLSFGRPFHLNFCDFL

SEQ ID NO: 828 - protein, 309 aa, Artificial
  MAGE-1 consensus polypeptide
MSLEQRSLHCKPEEALEAQQEALGLVCVQAATSSSSPLVLGTLEEVPTAGSTDPPQSPQGASAFPTTINFTRQRQPSEGSSSREEEGPSTSCILESLFRAVITKKVADLVGFLLLKYRAREPVTKAEMLESVIKNYKHCFPEIFGKASESLQLVFGIDVKEADPTGHSYVLVTCLGLSYDGLLGDNQIMPKTGFLIIVLVMIAMEGGHAPEEEIWEELSVMEVYDGREHSAYGEPRKLLTQDLVQEKYLEYRQVPDSDPARYEFLWGPRALAETSYVKVLEYVIKVSARVRFFFPSLREAALREEEEGV

SEQ ID NO: 829 - protein, 314 aa, Artificial
  MAGE-3 consensus polypeptide
MPLEQRSQHCKPEEGLEARGEALGLVGAQAPATEEQEAASSSSTLVEVTLGEVPAAESPDPPQSPQGASSLPTTMNYPLWSQSYEDSSNQEEEGPSTFPDLESEFQAALSRKVAELVHFLLLKYRAREPVTKAEMLGSVVGNWQYFFPVIFSKASSSLQLVFGIELMEVDPIGHLYIFATCLGLSYDGLLGDNQIMPKAGLLIIVLAIIAREGDCAPEEKIWEELSVLEVFEGREDSILGDPKKLLTQHFVQENYLEYRQVPGSDPACYEFLWGPRALVETSYVKVLHHMVKISGGPHISYPPLHEWVLREGEE

SEQ ID NO: 830 - protein, 509 aa, Artificial
  PRAME consensus polypeptide
MERRRLWGSIQSRYISMSVWTSPRRLVELAGQSLLKDEALAIAALELLPRELFPPLFMAAFDGRHSQTLKAMVQAWPFTCLPLGVLMKGQHLHLETFKAVLDGLDVLLAQEVRPRRWKLQVLDLRKNSHQDFWTVWSGNRASLYSFPEPEAAQPMTKKRKVDGLSTEAEQPFIPVEVLVDLFLKEGACDELFSYLIEKVKRKKNVLRLCCKKLKIFAMPMQDIKMILKMVQLDSIEDLEVTCTWKLPTLAKFSPYLGQMINLRRLLLSHIHASSYISPEKEEQYIAQFTSQFLSLQCLQALYVDSLFFLRGRLDQLLRHVMNPLETLSITNCRLSEGDVMHLSQSPSVSQLSVLSLSGVMLTDVSPEPLQALLERASATLQDLVFDECGITDDQLLALLPSLSHCSQLTTLSFYGNSISISALQSLLQHLIGLSNLTHVLYPVPLESYEDIHGTLHLERLAYLHARLRELLCELGRPSMVWLSANPCPHCGDRTFYDPEPILCPCFMPN

SEQ ID NO: 831 - protein, 54 aa, Artificial
  TRP2IN2 consensus polypeptide
LMETHLSSKRYTEEAGGFFPWLKVYYYRFVIGLRVWQWEVISCKLIKRATTRQP

SEQ ID NO: 832 - protein, 180 aa, Artificial
  NYNSO1a consensus polypeptide
MQAEGRGTGGSTGDADGPGGPGIPDGPGGNAGGPGEAGATGGRGPRGAGAARASGPGGGAPRGPHGGAASGLNGCCRCGARGPESRLLEFYLAMPFATPMEAELARRSLAQDAPPLPVPGVLLKEFTVSGNILTIRLTAADHRQLQLSISSCLQQLSLLMWITQCFLPVFLAQPPSGQRR

SEQ ID NO: 833 - protein, 58 aa, Artificial
  NYNSO1b consensus polypeptide
MLMAQEALAFLMAQGAMLAAQERRVPRAAEVPGAQGQQGPRGREEAPRGVRMAARLQG

SEQ ID NO: 834 - protein, 180 aa, Artificial
  LAGE1 consensus polypeptide
MQAEGQGTGGSTGDADGPGGPGIPDGPGGNAGGPGEAGATGGRGPRGAGAARASGPRGGAPRGPHGGAASAQDGRCPCGARRPDSRLLQLHITMPFSSPMEAELVRRILSRDAAPLPRPGAVLKDFTVSGNLLFIRLTAADHRQLQLSISSCLQQLSLLMWITQCFLPVFLAQAPSGQRR

SEQ ID NO: 835 - DNA, 90 bp, Artificial
  gp100 segment 1
  CDS (1)..(90)
gccgctatggatctggtcctgaaaaggtgtctgctccacctcgccgtcatcggagccctcctggctgtgggagccacaaaggtccccaga

SEQ ID NO: 836 - protein, 30 aa, Artificial
  gp100 segment 1
AAMDLVLKRCLLHLAVIGALLAVGATKVPR

SEQ ID NO: 837 - DNA, 90 bp, Artificial
  gp100 segment 2
  CDS (1)..(90)
gtgattggcgctctgctcgccgtcggcgctaccaaagtgcctaggaatcaggattggctcggcgtcagcagacagctcaggacaaaggct

SEQ ID NO: 838 - protein, 30 aa, Artificial
  gp100 segment 2
VIGALLAVGATKVPRNQDWLGVSRQLRTKA

SEQ ID NO: 839 - DNA, 90 bp, Artificial
  gp100 segment 3
  CDS (1)..(90)
aaccaagactggctgggagtgtccaggcaactgagaaccaaagcctggaacagacagctctaccctgagtggaccgaagcccaaaggctc

SEQ ID NO: 840 - protein, 30 aa, Artificial
  gp100 segment 3
NQDWLGVSRQLRTKAWNRQLYPEWTEAQRL

SEQ ID NO: 841 - DNA, 90 bp, Artificial
  gp100 segment 4
  CDS (1)..(90)
tggaataggcaactgtatcccgaatggacagaggctcagagactggattgctggaggggaggccaagtgtccctgaaagtgtccaacgat

SEQ ID NO: 842 - protein, 30 aa, Artificial
  gp100 segment 4
WNRQLYPEWTEAQRLDCWRGGQVSLKVSND

SEQ ID NO: 843 - DNA, 90 bp, Artificial
  gp100 segment 5
  CDS (1)..(90)
gactgttggagaggcggacaggtcagcctcaaggtcagcaatgacggacccacactgattggcgctaacgctagctttagcattgccctc

SEQ ID NO: 844 - protein, 30 aa, Artificial
  gp100 segment 5
DCWRGGQVSLKVSNDGPTLIGANASFSIAL

SEQ ID NO: 845 - DNA, 90 bp, Artificial
  gp100 segment 6
  CDS (1)..(90)
ggccctaccctcatcggagccaatgcctccttctccatcgctctgaatttccctggctcccagaaagtgctccccgatggccaagtgatt

SEQ ID NO: 846 - protein, 30 aa, Artificial
  gp100 segment 6
GPTLIGANASFSIALNFPGSQKVLPDGQVI

SEQ ID NO: 847 - DNA, 90 bp, Artificial
  gp100 segment 7
  CDS (1)..(90)
aactttcccggaagccaaaaggtcctgcctgacggacaggtcatctgggtgaataacacaatcattaacggaagccaagtgtggggcgga

SEQ ID NO: 848 - protein, 30 aa, Artificial
  gp100 segment 7
NFPGSQKVLPDGQVIWVNNTIINGSQVWGG

SEQ ID NO: 849 - DNA, 90 bp, Artificial
  gp100 segment 8
  CDS (1)..(90)
tgggtcaacaataccattatcaatggctcccaggtctggggaggccaacccgtctaccctcaggaaaccgatgacgcttgcattttccct

SEQ ID NO: 850 - protein, 30 aa, Artificial
  gp100 segment 8
WVNNTIINGSQVWGGQPVYPQETDDACIFP

SEQ ID NO: 851 - DNA, 90 bp, Artificial
  gp100 segment 9
  CDS (1)..(90)
cagcctgtgtatccccaagagacagacgatgcctgtatctttcccgatggcggaccctgtccctccggctcctggtcccagaaaaggtcc

SEQ ID NO: 852 - protein, 30 aa, Artificial
  gp100 segment 9
QPVYPQETDDACIFPDGGPCPSGSWSQKRS

SEQ ID NO: 853 - DNA, 90 bp, Artificial
  gp100 segment 10
  CDS (1)..(90)
gacggaggcccttgccctagcggaagctggagccaaaagagaagctttgtgtatgtgtggaagacatggggacagtattggcaagtgctc

SEQ ID NO: 854 - protein, 30 aa, Artificial
  gp100 segment 10
DGGPCPSGSWSQKRSFVYVWKTWGQYWQVL

SEQ ID NO: 855 - DNA, 90 bp, Artificial
  gp100 segment 11
  CDS (1)..(90)
ttcgtctacgtctggaaaacctggggccaatactggcaggtcctgggaggccctgtgtccggcctcagcattggcacaggcagagccatg

SEQ ID NO: 856 - protein, 30 aa, Artificial
  gp100 segment 11
FVYVWKTWGQYWQVLGGPVSGLSIGTGRAM

SEQ ID NO: 857 - DNA, 90 bp, Artificial
  gp100 segment 12
  CDS (1)..(90)
ggcggacccgtcagcggactgtccatcggaaccggaagggctatgctcggcacacacacaatggaagtgacagtgtatcacagaagggga

SEQ ID NO: 858 - protein, 30 aa, Artificial
  gp100 segment 12
GGPVSGLSIGTGRAMLGTHTMEVTVYHRRG

SEQ ID NO: 859 - DNA, 90 bp, Artificial
  gp100 segment 13
  CDS (1)..(90)
ctgggaacccataccatggaggtcaccgtctaccataggagaggctccaggtcctacgtccccctcgcccatagctccagcgctttcaca

SEQ ID NO: 860 - protein, 30 aa, Artificial
  gp100 segment 13
LGTHTMEVTVYHRRGSRSYVPLAHSSSAFT

SEQ ID NO: 861 - DNA, 90 bp, Artificial
  gp100 segment 14
  CDS (1)..(90)
agcagaagctatgtgcctctggctcactccagctccgcctttaccattaccgatcaggtcccctttagcgtcagcgtcagccaactgaga

SEQ ID NO: 862 - protein, 30 aa, Artificial
  gp100 segment 14
SRSYVPLAHSSSAFTITDQVPFSVSVSQLR

SEQ ID NO: 863 - DNA, 90 bp, Artificial
  gp100 segment 15
  CDS (1)..(90)
atcacagaccaagtgcctttctccgtgtccgtgtcccagctcagggctctggatggcggaaacaaacactttctgagaaaccaacccctc

SEQ ID NO: 864 - protein, 30 aa, Artificial
  gp100 segment 15
ITDQVPFSVSVSQLRALDGGNKHFLRNQPL

SEQ ID NO: 865 - DNA, 90 bp, Artificial
  gp100 segment 16
  CDS (1)..(90)
gccctcgacggaggcaataagcatttcctcaggaatcagcctctgacattcgctctgcaactgcatgaccctagcggatacctcgccgaa

SEQ ID NO: 866 - protein, 30 aa, Artificial
  gp100 segment 16
ALDGGNKHFLRNQPLTFALQLHDPSGYLAE

SEQ ID NO: 867 - DNA, 90 bp, Artificial
  gp100 segment 17
  CDS (1)..(90)
acctttgccctccagctccacgatccctccggctatctggctgaggctgacctcagctatacctgggactttggcgatagctccggcaca

SEQ ID NO: 868 - protein, 30 aa, Artificial
  gp100 segment 17
TFALQLHDPSGYLAEADLSYTWDFGDSSGT

SEQ ID NO: 869 - DNA, 90 bp, Artificial
  gp100 segment 18
  CDS (1)..(90)
gccgatctgtcctacacatgggatttcggagactccagcggaaccctcatctccagggctctggtcgtgacacacacatacctcgagcct

SEQ ID NO: 870 - protein, 30 aa, Artificial
  gp100 segment 18
ADLSYTWDFGDSSGTLISRALVVTHTYLEP

SEQ ID NO: 871 - DNA, 90 bp, Artificial
  gp100 segment 19
  CDS (1)..(90)
ctgattagcagagccctcgtggtcacccatacctatctggaacccggacccgtcaccgctcaggtcgtgctccaggctgccattcccctc

SEQ ID NO: 872 - protein, 30 aa, Artificial
  gp100 segment 19
LISRALVVTHTYLEPGPVTAQVVLQAAIPL

SEQ ID NO: 873 - DNA, 90 bp, Artificial
  gp100 segment 20
  CDS (1)..(90)
ggccctgtgacagcccaagtggtcctgcaagccgctatccctctgacaagctgtggctccagccctgtgcctggcacaaccgatggccat

SEQ ID NO: 874 - protein, 30 aa, Artificial
  gp100 segment 20
GPVTAQVVLQAAIPLTSCGSSPVPGTTDGH

SEQ ID NO: 875 - DNA, 90 bp, Artificial
  gp100 segment 21
  CDS (1)..(90)
acctcctgcggaagctcccccgtccccggaaccacagacggacacagacccacagccgaagcccctaacacaaccgctggccaagtgcct

SEQ ID NO: 876 - protein, 30 aa, Artificial
  gp100 segment 21
TSCGSSPVPGTTDGHRPTAEAPNTTAGQVP

SEQ ID NO: 877 - DNA, 90 bp, Artificial
  gp100 segment 22
  CDS (1)..(90)
aggcctaccgctgaggctcccaataccacagccggacaggtccccacaaccgaagtggtcggcacaacccctggccaagcccctaccgct

SEQ ID NO: 878 - protein, 30 aa, Artificial
  gp100 segment 22
RPTAEAPNTTAGQVPTTEVVGTTPGQAPTA

SEQ ID NO: 879 - DNA, 90 bp, Artificial
  gp100 segment 23
  CDS (1)..(90)
accacagaggtcgtgggaaccacacccggacaggctcccacagccgaaccctccggcacaacctccgtgcaagtgcctaccacagaggtc

SEQ ID NO: 880 - protein, 30 aa, Artificial
  gp100 segment 23
TTEVVGTTPGQAPTAEPSGTTSVQVPTTEV

SEQ ID NO: 881 - DNA, 90 bp, Artificial
  gp100 segment 24
  CDS (1)..(90)
gagcctagcggaaccacaagcgtccaggtccccacaaccgaagtgattagcacagcccctgtgcaaatgcctaccgctgagtccaccgga

SEQ ID NO: 882 - protein, 30 aa, Artificial
  gp100 segment 24
EPSGTTSVQVPTTEVISTAPVQMPTAESTG

SEQ ID NO: 883 - DNA, 90 bp, Artificial
  gp100 segment 25
  CDS (1)..(90)
atctccaccgctcccgtccagatgcccacagccgaaagcacaggcatgacccctgagaaagtgcctgtgtccgaggtcatgggaaccaca

SEQ ID NO: 884 - protein, 30 aa, Artificial
  gp100 segment 25
ISTAPVQMPTAESTGMTPEKVPVSEVMGTT

SEQ ID NO: 885 - DNA, 90 bp, Artificial
  gp100 segment 26
  CDS (1)..(90)
atgacacccgaaaaggtccccgtcagcgaagtgatgggcacaaccctcgccgaaatgtccacccctgaggctaccggaatgacacccgct

SEQ ID NO: 886 - protein, 30 aa, Artificial
  gp100 segment 26
MTPEKVPVSEVMGTTLAEMSTPEATGMTPA

SEQ ID NO: 887 - DNA, 90 bp, Artificial
  gp100 segment 27
  CDS (1)..(90)
ctggctgagatgagcacacccgaagccacaggcatgacccctgccgaagtgtccatcgtcgtgctcagcggaaccacagccgctcaggtc

SEQ ID NO: 888 - protein, 30 aa, Artificial
  gp100 segment 27
LAEMSTPEATGMTPAEVSIVVLSGTTAAQV

SEQ ID NO: 889 - DNA, 90 bp, Artificial
  gp100 segment 28
  CDS (1)..(90)
gaggtcagcattgtggtcctgtccggcacaaccgctgcccaagtgacaaccacagagtgggtggaaaccacagccagagagctccccatt

SEQ ID NO: 890 - protein, 30 aa, Artificial
  gp100 segment 28
EVSIVVLSGTTAAQVTTTEWVETTARELPI

SEQ ID NO: 891 - DNA, 90 bp, Artificial
  gp100 segment 29
  CDS (1)..(90)
accacaaccgaatgggtcgagacaaccgctagggaactgcctatccctgagcctgagggacccgatgcctccagcattatgtccaccgaa

SEQ ID NO: 892 - protein, 30 aa, Artificial
  gp100 segment 29
TTTEWVETTARELPIPEPEGPDASSIMSTE

SEQ ID NO: 893 - DNA, 90 bp, Artificial
  gp100 segment 30
  CDS (1)..(90)
cccgaacccgaaggccctgacgctagctccatcatgagcacagagtccatcacaggctccctgggacccctcctggatggcacagccaca

SEQ ID NO: 894 - protein, 30 aa, Artificial
  gp100 segment 30
PEPEGPDASSIMSTESITGSLGPLLDGTAT

SEQ ID NO: 895 - DNA, 90 bp, Artificial
  gp100 segment 31
  CDS (1)..(90)
agcattaccggaagcctcggccctctgctcgacggaaccgctaccctcaggctcgtgaaaaggcaagtgcctctggattgcgtcctgtat

SEQ ID NO: 896 - protein, 30 aa, Artificial
  gp100 segment 31
SITGSLGPLLDGTATLRLVKRQVPLDCVLY

SEQ ID NO: 897 - DNA, 90 bp, Artificial
  gp100 segment 32
  CDS (1)..(90)
ctgagactggtcaagagacaggtccccctcgactgtgtgctctacagatacggaagctttagcgtcaccctcgacattgtgcaaggcatt

SEQ ID NO: 898 - protein, 30 aa, Artificial
  gp100 segment 32
LRLVKRQVPLDCVLYRYGSFSVTLDIVQGI

SEQ ID NO: 899 - DNA, 90 bp, Artificial
  gp100 segment 33
  CDS (1)..(90)
aggtatggctccttctccgtgacactggatatcgtccagggaatcgaaagcgctgagattctgcaagccgtcccctccggcgaaggcgat

SEQ ID NO: 900 - protein, 30 aa, Artificial
  gp100 segment 33
RYGSFSVTLDIVQGIESAEILQAVPSGEGD

SEQ ID NO: 901 - DNA, 90 bp, Artificial
  gp100 segment 34
  CDS (1)..(90)
gagtccgccgaaatcctccaggctgtgcctagcggagagggagacgctttcgaactgacagtgtcctgccaaggcggactgcctaaggaa

SEQ ID NO: 902 - protein, 30 aa, Artificial
  gp100 segment 34
ESAEILQAVPSGEGDAFELTVSCQGGLPKE

SEQ ID NO: 903 - DNA, 90 bp, Artificial
  gp100 segment 35
  CDS (1)..(90)
gcctttgagctcaccgtcagctgtcagggaggcctccccaaagaggcttgcatggagattagctcccccggatgccaaccccctgcccaa

SEQ ID NO: 904 - protein, 30 aa, Artificial
  gp100 segment 35
AFELTVSCQGGLPKEACMEISSPGCQPPAQ

SEQ ID NO: 905 - DNA, 90 bp, Artificial
  gp100 segment 36
  CDS (1)..(90)
gcctgtatggaaatctccagccctggctgtcagcctcccgctcagagactgtgtcagcctgtgctcccctcccccgcttgccaactggtc

SEQ ID NO: 906 - protein, 30 aa, Artificial
  gp100 segment 36
ACMEISSPGCQPPAQRLCQPVLPSPACQLV

SEQ ID NO: 907 - DNA, 90 bp, Artificial
  gp100 segment 37
  CDS (1)..(90)
aggctctgccaacccgtcctgcctagccctgcctgtcagctcgtgctccaccaaatcctcaagggaggctccggcacatactgtctgaat

SEQ ID NO: 908 - protein, 30 aa, Artificial
  gp100 segment 37
RLCQPVLPSPACQLVLHQILKGGSGTYCLN

SEQ ID NO: 909 - DNA, 90 bp, Artificial
  gp100 segment 38
  CDS (1)..(90)
ctgcatcagattctgaaaggcggaagcggaacctattgcctcaacgtcagcctcgccgataccaatagcctcgccgtcgtgtccacccaa

SEQ ID NO: 910 - protein, 30 aa, Artificial
  gp100 segment 38
LHQILKGGSGTYCLNVSLADTNSLAVVSTQ

SEQ ID NO: 911 - DNA, 90 bp, Artificial
  gp100 segment 39
  CDS (1)..(90)
gtgtccctggctgacacaaactccctggctgtggtcagcacacagctcatcatgcccggacaggaagccggactgggacaggtccccctc

SEQ ID NO: 912 - protein, 30 aa, Artificial
  gp100 segment 39
VSLADTNSLAVVSTQLIMPGQEAGLGQVPL

SEQ ID NO: 913 - DNA, 90 bp, Artificial
  gp100 segment 40
  CDS (1)..(90)
ctgattatgcctggccaagaggctggcctcggccaagtgcctctgattgtgggaatcctcctggtcctgatggccgtcgtgctcgcctcc

SEQ ID NO: 914 - protein, 30 aa, Artificial
  gp100 segment 40
LIMPGQEAGLGQVPLIVGILLVLMAVVLAS

SEQ ID NO: 915 - DNA, 90 bp, Artificial
  gp100 segment 41
  CDS (1)..(90)
atcgtcggcattctgctcgtgctcatggctgtggtcctggctagcctcatctataggagaaggctcatgaaacaggatttctccgtgcct

SEQ ID NO: 916 - protein, 30 aa, Artificial
  gp100 segment 41
IVGILLVLMAVVLASLIYRRRLMKQDFSVP

SEQ ID NO: 917 - DNA, 90 bp, Artificial
  gp100 segment 42
  CDS (1)..(90)
ctgatttacagaaggagactgatgaagcaagactttagcgtcccccaactgcctcactccagctcccactggctgagactgcctaggatt

SEQ ID NO: 918 - protein, 30 aa, Artificial
  gp100 segment 42
LIYRRRLMKQDFSVPQLPHSSSHWLRLPRI

SEQ ID NO: 919 - DNA, 90 bp, Artificial
  gp100 segment 43
  CDS (1)..(90)
cagctcccccatagctccagccattggctcaggctccccagaatcttttgctcctgccctatcggagagaatagccctctgctcagcgga

SEQ ID NO: 920 - protein, 30 aa, Artificial
  gp100 segment 43
QLPHSSSHWLRLPRIFCSCPIGENSPLLSG

SEQ ID NO: 921 - DNA, 60 bp, Artificial
  gp100 segment 44
  CDS (1)..(60)
ttctgtagctgtcccattggcgaaaactcccccctcctgtccggccaacaggtcgccgct

SEQ ID NO: 922 - protein, 20 aa, Artificial
  gp100 segment 44
FCSCPIGENSPLLSGQQVAA

SEQ ID NO: 923 - DNA, 90 bp, Artificial
  MART segment 1
  CDS (1)..(90)
gccgctatgcctagggaagacgctcactttatctatggctatcccaaaaagggacacggacactcctacacaaccgctgaggaagccgct

SEQ ID NO: 924 - protein, 30 aa, Artificial
  MART segment 1
AAMPREDAHFIYGYPKKGHGHSYTTAEEAA

SEQ ID NO: 925 - DNA, 90 bp, Artificial
  MART segment 2
  CDS (1)..(90)
aagaaaggccatggccatagctataccacagccgaagaggctgccggaatcggaatcctcaccgtcatcctcggcgtcctgctcctgatt

SEQ ID NO: 926 - protein, 30 aa, Artificial
  MART segment 2
KKGHGHSYTTAEEAAGIGILTVILGVLLLI

SEQ ID NO: 927 - DNA, 90 bp, Artificial
  MART segment 3
  CDS (1)..(90)
ggcattggcattctgacagtgattctgggagtgctcctgctcatcggatgctggtactgtaggagaaggaatggctatagggctctgatg

SEQ ID NO: 928 - protein, 30 aa, Artificial
  MART segment 3
GIGILTVILGVLLLIGCWYCRRRNGYRALM

SEQ ID NO: 929 - DNA, 90 bp, Artificial
  MART segment 4
  CDS (1)..(90)
ggctgttggtattgcagaaggagaaacggatacagagccctcatggataagtccctgcatgtgggaacccaatgcgctctgacaaggaga

SEQ ID NO: 930 - protein, 30 aa, Artificial
  MART segment 4
GCWYCRRRNGYRALMDKSLHVGTQCALTRR

SEQ ID NO: 931 - DNA, 90 bp, Artificial
  MART segment 5
  CDS (1)..(90)
gacaaaagcctccacgtcggcacacagtgtgccctcaccagaaggtgtccccaagagggattcgatcacagagactccaaggtcagcctc

SEQ ID NO: 932 - protein, 30 aa, Artificial
  MART segment 5
DKSLHVGTQCALTRRCPQEGFDHRDSKVSL

SEQ ID NO: 933 - DNA, 90 bp, Artificial
  MART segment 6
  CDS (1)..(90)
tgccctcaggaaggctttgaccatagggatagcaaagtgtccctgcaagagaaaaactgtgagcctgtggtccccaatgcccctcccgct

SEQ ID NO: 934 - protein, 30 aa, Artificial
  MART segment 6
CPQEGFDHRDSKVSLQEKNCEPVVPNAPPA

SEQ ID NO: 935 - DNA, 90 bp, Artificial
  MART segment 7
  CDS (1)..(90)
caggaaaagaattgcgaacccgtcgtgcctaacgctccccctgcctatgagaaactgtccgccgaacagtccccccctccctatagccct

SEQ ID NO: 936 - protein, 30 aa, Artificial
  MART segment 7
QEKNCEPVVPNAPPAYEKLSAEQSPPPYSP

SEQ ID NO: 937 - DNA, 51 bp, Artificial
  MART segment 8
  CDS (1)..(51)
tacgaaaagctcagcgctgagcaaagccctcccccttactcccccgctgcc

SEQ ID NO: 938 - protein, 17 aa, Artificial
  MART segment 8
YEKLSAEQSPPPYSPAA

SEQ ID NO: 939 - DNA, 90 bp, Artificial
  trp-1 segment 1
  CDS (1)..(90)
gccgctcccgctttcctcacctggcacagataccatctgctcaggctcgagaaagacatgcaggaaatgctccaggaaccctccttctcc

SEQ ID NO: 940 - protein, 30 aa, Artificial
  trp-1 segment 1
AAPAFLTWHRYHLLRLEKDMQEMLQEPSFS

SEQ ID NO: 941 - DNA, 90 bp, Artificial
  trp-1 segment 2
  CDS (1)..(90)
ctggaaaaggatatgcaagagatgctgcaagagcctagctttagcctcccctattggaatttcgctaccggaaagaatgtgtgtgacatt

SEQ ID NO: 942 - protein, 30 aa, Artificial
  trp-1 segment 2
LEKDMQEMLQEPSFSLPYWNFATGKNVCDI

SEQ ID NO: 943 - DNA, 90 bp, Artificial
  trp-1 segment 3
  CDS (1)..(90)
ctgccttactggaactttgccacaggcaaaaacgtctgcgatatctgtaccgatgacctcatgggaagcagaagcaatttcgatagcaca

SEQ ID NO: 944 - protein, 30 aa, Artificial
  trp-1 segment 3
LPYWNFATGKNVCDICTDDLMGSRSNFDST

SEQ ID NO: 945 - DNA, 90 bp, Artificial
  trp-1 segment 4
  CDS (1)..(90)
tgcacagacgatctgatgggctccaggtccaactttgactccaccctcatctcccccaatagcgtcttctcccagtggagggtcgtgtgt

SEQ ID NO: 946 - protein, 30 aa, Artificial
  trp-1 segment 4
CTDDLMGSRSNFDSTLISPNSVFSQWRVVC

SEQ ID NO: 947 - DNA, 90 bp, Artificial
  trp-1 segment 5
  CDS (1)..(90)
ctgattagccctaactccgtgtttagccaatggagagtggtctgcgatagcctcgaggattacgataccctcggcacactgtgtaactcc

SEQ ID NO: 948 - protein, 30 aa, Artificial
  trp-1 segment 5
LISPNSVFSQWRVVCDSLEDYDTLGTLCNS

SEQ ID NO: 949 - DNA, 90 bp, Artificial
  trp-1 segment 6
  CDS (1)..(90)
gactccctggaagactatgacacactgggaaccctctgcaatagcacagaggatggccctatcagaaggaatcccgctggcaatgtggct

SEQ ID NO: 950 - protein, 30 aa, Artificial
  trp-1 segment 6
DSLEDYDTLGTLCNSTEDGPIRRNPAGNVA

SEQ ID NO: 951 - DNA, 90 bp, Artificial
  trp-1 segment 7
  CDS (1)..(90)
accgaagacggacccattaggagaaaccctgccggaaacgtcgccagacccatggtgcaaaggctccccgaaccccaagacgtcgcccaa

SEQ ID NO: 952 - protein, 30 aa, Artificial
  trp-1 segment 7
TEDGPIRRNPAGNVARPMVQRLPEPQDVAQ

SEQ ID NO: 953 - DNA, 90 bp, Artificial
  trp-1 segment 8
  CDS (1)..(90)
aggcctatggtccagagactgcctgagcctcaggatgtggctcagtgtctggaagtgggactgtttgacacaccccctttctatagcaat

SEQ ID NO: 954 - protein, 30 aa, Artificial
  trp-1 segment 8
RPMVQRLPEPQDVAQCLEVGLFDTPPFYSN

SEQ ID NO: 955 - DNA, 90 bp, Artificial
  trp-1 segment 9
  CDS (1)..(90)
tgcctcgaggtcggcctcttcgatacccctcccttttactccaactccaccaatagctttaggaataccgtcgagggatactccgaccct

SEQ ID NO: 956 - protein, 30 aa, Artificial
  trp-1 segment 9
CLEVGLFDTPPFYSNSTNSFRNTVEGYSDP

SEQ ID NO: 957 - DNA, 90 bp, Artificial
  trp-1 segment 10
  CDS (1)..(90)
agcacaaactccttcagaaacacagtggaaggctatagcgatcccacaggcaaatacgatcccgctgtgagaagcctccacaatctggct

SEQ ID NO: 958 - protein, 30 aa, Artificial
  trp-1 segment 10
STNSFRNTVEGYSDPTGKYDPAVRSLHNLA

SEQ ID NO: 959 - DNA, 90 bp, Artificial
  trp-1 segment 11
  CDS (1)..(90)
accggaaagtatgaccctgccgtcaggtccctgcataacctcgcccatctgtttctgaatggcacaggcggacagacacacctcagctcc

SEQ ID NO: 960 - protein, 30 aa, Artificial
  trp-1 segment 11
TGKYDPAVRSLHNLAHLFLNGTGGQTHLSS

SEQ ID NO: 961 - DNA, 90 bp, Artificial
  trp-1 segment 12
  CDS (1)..(90)
cacctcttcctcaacggaaccggaggccaaacccatctgtccagccaagaccctatctttgtgctcctgcatacctttaccgatgccgtc

SEQ ID NO: 962 - protein, 30 aa, Artificial
  trp-1 segment 12
HLFLNGTGGQTHLSSQDPIFVLLHTFTDAV

SEQ ID NO: 963 - DNA, 90 bp, Artificial
  trp-1 segment 13
  CDS (1)..(90)
caggatcccattttcgtcctgctccacacattcacagacgctgtgtttgacgaatggctcaggagatacaatgccgatatctccaccttt

SEQ ID NO: 964 - protein, 30 aa, Artificial
  trp-1 segment 13
QDPIFVLLHTFTDAVFDEWLRRYNADISTF

SEQ ID NO: 965 - DNA, 90 bp, Artificial
  trp-1 segment 14
  CDS (1)..(90)
ttcgatgagtggctgagaaggtataacgctgacattagcacattccctctggaaaacgctcccattggccataacagacagtataacatg

SEQ ID NO: 966 - protein, 30 aa, Artificial
  trp-1 segment 14
FDEWLRRYNADISTFPLENAPIGHNRQYNM

SEQ ID NO: 967 - DNA, 90 bp, Artificial
  trp-1 segment 15
  CDS (1)..(90)
cccctcgagaatgcccctatcggacacaataggcaatacaatatggtccccttttggcctcccgtcaccaataccgaaatgtttgtgaca

SEQ ID NO: 968 - protein, 30 aa, Artificial
  trp-1 segment 15
PLENAPIGHNRQYNMVPFWPPVTNTEMFVT

SEQ ID NO: 969 - DNA, 81 bp, Artificial
  trp-1 segment 16
  CDS (1)..(81)
gtgcctttctggccccctgtgacaaacacagagatgttcgtcaccgctcccgataacctcggctatacctatgaggctgcc

SEQ ID NO: 970 - protein, 27 aa, Artificial
  trp-1 segment 16
VPFWPPVTNTEMFVTAPDNLGYTYEAA

SEQ ID NO: 971 - DNA, 90 bp, Artificial
  tyros segment 1
  CDS (1)..(90)
gccgctatgctcctggctgtgctctactgtctgctctggtccttccaaacctccgccggacactttcccagagcctgtgtgtccagcaaa

SEQ ID NO: 972 - protein, 30 aa, Artificial
  tyros segment 1
AAMLLAVLYCLLWSFQTSAGHFPRACVSSK

SEQ ID NO: 973 - DNA, 90 bp, Artificial
  tyros segment 2
  CDS (1)..(90)
cagacaagcgctggccatttccctagggcttgcgtcagctccaagaatctgatggagaaagagtgttgccctccctggagcggagacaga

SEQ ID NO: 974 - protein, 30 aa, Artificial
  tyros segment 2
QTSAGHFPRACVSSKNLMEKECCPPWSGDR

SEQ ID NO: 975 - DNA, 90 bp, Artificial
  tyros segment 3
  CDS (1)..(90)
aacctcatggaaaaggaatgctgtcccccttggtccggcgataggtccccctgtggccaactgtccggcagaggctcctgccaaaacatt

SEQ ID NO: 976 - protein, 30 aa, Artificial
  tyros segment 3
NLMEKECCPPWSGDRSPCGQLSGRGSCQNI

SEQ ID NO: 977 - DNA, 90 bp, Artificial
  tyros segment 4
  CDS (1)..(90)
agcccttgcggacagctcagcggaaggggaagctgtcagaatatcctcctgtccaacgctcccctcggccctcagtttccctttaccgga

SEQ ID NO: 978 - protein, 30 aa, Artificial
  tyros segment 4
SPCGQLSGRGSCQNILLSNAPLGPQFPFTG

SEQ ID NO: 979 - DNA, 90 bp, Artificial
  tyros segment 5
  CDS (1)..(90)
ctgctcagcaatgcccctctgggaccccaattccctttcacaggcgtcgacgatagggaaagctggccctccgtgttttacaataggaca

SEQ ID NO: 980 - protein, 30 aa, Artificial
  tyros segment 5
LLSNAPLGPQFPFTGVDDRESWPSVFYNRT

SEQ ID NO: 981 - DNA, 90 bp, Artificial
  tyros segment 6
  CDS (1)..(90)
gtggatgacagagagtcctggcctagcgtcttctataacagaacctgtcagtgtagcggaaactttatgggattcaattgcggaaactgt

SEQ ID NO: 982 - protein, 30 aa, Artificial
  tyros segment 6
VDDRESWPSVFYNRTCQCSGNFMGFNCGNC

SEQ ID NO: 983 - DNA, 90 bp, Artificial
  tyros segment 7
  CDS (1)..(90)
tgccaatgctccggcaatttcatgggctttaactgtggcaattgcaaattcggattctggggccctaactgtaccgaaaggagactgctc

SEQ ID NO: 984 - protein, 30 aa, Artificial
  tyros segment 7
CQCSGNFMGFNCGNCKFGFWGPNCTERRLL

SEQ ID NO: 985 - DNA, 90 bp, Artificial
  tyros segment 8
  CDS (1)..(90)
aagtttggcttttggggacccaattgcacagagagaaggctcctggtcaggagaaacattttcgatctgtccgcccctgagaaagacaaa

SEQ ID NO: 986 - protein, 30 aa, Artificial
  tyros segment 8
KFGFWGPNCTERRLLVRRNIFDLSAPEKDK

SEQ ID NO: 987 - DNA, 90 bp, Artificial
  tyros segment 9
  CDS (1)..(90)
gtgagaaggaatatctttgacctcagcgctcccgaaaaggataagtttttcgcttacctcaccctcgccaaacacacaatctccagcgat

SEQ ID NO: 988 - protein, 30 aa, Artificial
  tyros segment 9
VRRNIFDLSAPEKDKFFAYLTLAKHTISSD

SEQ ID NO: 989 - DNA, 90 bp, Artificial
  tyros segment 10
  CDS (1)..(90)
ttctttgcctatctgacactggctaagcataccattagctccgactatgtgattcccattggcacatacggacagatgaagaatggctcc

SEQ ID NO: 990 - protein, 30 aa, Artificial
  tyros segment 10
FFAYLTLAKHTISSDYVIPIGTYGQMKNGS

SEQ ID NO: 991 - DNA, 90 bp, Artificial
  tyros segment 11
  CDS (1)..(90)
tacgtcatccctatcggaacctatggccaaatgaaaaacggaagcacacccatgttcaatgacattaacatttacgatctgtttgtgtgg

SEQ ID NO: 992 - protein, 30 aa, Artificial
  tyros segment 11
YVIPIGTYGQMKNGSTPMFNDINIYDLFVW

SEQ ID NO: 993 - DNA, 90 bp, Artificial
  tyros segment 12
  CDS (1)..(90)
acccctatgtttaacgatatcaatatctatgacctcttcgtctggatgcactattacgtcagcatggacgctctgctcggcggaagcgaa

SEQ ID NO: 994 - protein, 30 aa, Artificial
  tyros segment 12
TPMFNDINIYDLFVWMHYYVSMDALLGGSE

SEQ ID NO: 995 - DNA, 90 bp, Artificial
  tyros segment 13
  CDS (1)..(90)
atgcattactatgtgtccatggatgccctcctgggaggctccgagatttggagagacattgactttgcccatgaggctcccgctttcctc

SEQ ID NO: 996 - protein, 30 aa, Artificial
  tyros segment 13
MHYYVSMDALLGGSEIWRDIDFAHEAPAFL

SEQ ID NO: 997 - DNA, 90 bp, Artificial
  tyros segment 14
  CDS (1)..(90)
atctggagggatatcgatttcgctcacgaagcccctgcctttctgccttggcataggctcttcctcctgagatgggaacaggaaatccaa

SEQ ID NO: 998 - protein, 30 aa, Artificial
  tyros segment 14
IWRDIDFAHEAPAFLPWHRLFLLRWEQEIQ

SEQ ID NO: 999 - DNA, 90 bp, Artificial
  tyros segment 15
  CDS (1)..(90)
ccctggcacagactgtttctgctcaggtgggagcaagagattcagaaactgacaggcgatgagaatttcacaatcccttactgggactgg

SEQ ID NO: 1000 - protein, 30 aa, Artificial
  tyros segment 15
PWHRLFLLRWEQEIQKLTGDENFTIPYWDW

SEQ ID NO: 1001 - DNA, 90 bp, Artificial
  tyros segment 16
  CDS (1)..(90)
aagctcaccggagacgaaaactttaccattccctattgggattggagagacgctgagaaatgcgatatctgtaccgatgagtatatggga

SEQ ID NO: 1002 - protein, 30 aa, Artificial
  tyros segment 16
KLTGDENFTIPYWDWRDAEKCDICTDEYMG

SEQ ID NO: 1003 - DNA, 90 bp, Artificial
  tyros segment 17
  CDS (1)..(90)
agggatgccgaaaagtgtgacatttgcacagacgaatacatgggcggacagcatcccacaaaccctaacctcctgtcccccgctagcttt

SEQ ID NO: 1004 - protein, 30 aa, Artificial
  tyros segment 17
RDAEKCDICTDEYMGGQHPTNPNLLSPASF

SEQ ID NO: 1005 - DNA, 90 bp, Artificial
  tyros segment 18
  CDS (1)..(90)
ggccaacaccctaccaatcccaatctgctcagccctgcctccttctttagctcctggcaaatcgtctgctccaggctcgaggaatacaat

SEQ ID NO: 1006 - protein, 30 aa, Artificial
  tyros segment 18
GQHPTNPNLLSPASFFSSWQIVCSRLEEYN

SEQ ID NO: 1007 - DNA, 90 bp, Artificial
  tyros segment 19
  CDS (1)..(90)
ttctccagctggcagattgtgtgtagcagactggaagagtataactcccaccaaagcctctgcaatggcacacccgaaggccctctgaga

SEQ ID NO: 1008 - protein, 30 aa, Artificial
  tyros segment 19
FSSWQIVCSRLEEYNSHQSLCNGTPEGPLR

SEQ ID NO: 1009 - DNA, 90 bp, Artificial
  tyros segment 20
  CDS (1)..(90)
agccatcagtccctgtgtaacggaacccctgagggacccctcaggagaaaccctggcaatcacgataagtccaggacacccagactgcct

SEQ ID NO: 1010 - protein, 30 aa, Artificial
  tyros segment 20
SHQSLCNGTPEGPLRRNPGNHDKSRTPRLP

SEQ ID NO: 1011 - DNA, 90 bp, Artificial
  tyros segment 21
  CDS (1)..(90)
aggaatcccggaaaccatgacaaaagcagaacccctaggctcccctccagcgctgacgtcgagttttgcctcagcctcacccaatacgaa

SEQ ID NO: 1012 - protein, 30 aa, Artificial
  tyros segment 21
RNPGNHDKSRTPRLPSSADVEFCLSLTQYE

SEQ ID NO: 1013 - DNA, 90 bp, Artificial
  tyros segment 22
  CDS (1)..(90)
agctccgccgatgtggaattctgtctgtccctgacacagtatgagtccggctccatggataaggctgccaatttctccttcagaaacaca

SEQ ID NO: 1014 - protein, 30 aa, Artificial
  tyros segment 22
SSADVEFCLSLTQYESGSMDKAANFSFRNT

SEQ ID NO: 1015 - DNA, 90 bp, Artificial
  tyros segment 23
  CDS (1)..(90)
agcggaagcatggacaaagccgctaactttagctttaggaataccctcgagggattcgctagccctctgacaggcattgccgatgcctcc

SEQ ID NO: 1016 - protein, 30 aa, Artificial
  tyros segment 23
SGSMDKAANFSFRNTLEGFASPLTGIADAS

SEQ ID NO: 1017 - DNA, 90 bp, Artificial
  tyros segment 24
  CDS (1)..(90)
ctggaaggctttgcctcccccctcaccggaatcgctgacgctagccaaagctccatgcataacgctctgcatatctatatgaatggcaca

SEQ ID NO: 1018 - protein, 30 aa, Artificial
  tyros segment 24
LEGFASPLTGIADASQSSMHNALHIYMNGT

SEQ ID NO: 1019 - DNA, 90 bp, Artificial
  tyros segment 25
  CDS (1)..(90)
cagtccagcatgcacaatgccctccacatttacatgaacggaaccatgagccaagtgcaaggctccgccaatgaccctatctttctgctc

SEQ ID NO: 1020 - protein, 30 aa, Artificial
  tyros segment 25
QSSMHNALHIYMNGTMSQVQGSANDPIFLL

SEQ ID NO: 1021 - DNA, 90 bp, Artificial
  tyros segment 26
  CDS (1)..(90)
atgtcccaggtccagggaagcgctaacgatcccattttcctcctgcatcacgctttcgtcgactccatctttgagcaatggctccagaga

SEQ ID NO: 1022 - protein, 30 aa, Artificial
  tyros segment 26
MSQVQGSANDPIFLLHHAFVDSIFEQWLQR

SEQ ID NO: 1023 - DNA, 90 bp, Artificial
  tyros segment 27
  CDS (1)..(90)
caccatgcctttgtggatagcattttcgaacagtggctgcaaaggcataggcctctgcaagaggtctaccctgaggctaacgctcccatt

SEQ ID NO: 1024 - protein, 30 aa, Artificial
  tyros segment 27
HHAFVDSIFEQWLQRHRPLQEVYPEANAPI

SEQ ID NO: 1025 - DNA, 90 bp, Artificial
  tyros segment 28
  CDS (1)..(90)
cacagacccctccaggaagtgtatcccgaagccaatgcccctatcggacacaatagggaaagctatatggtcccctttatccctctgtat

SEQ ID NO: 1026 - protein, 30 aa, Artificial
  tyros segment 28
HRPLQEVYPEANAPIGHNRESYMVPFIPLY

SEQ ID NO: 1027 - DNA, 90 bp, Artificial
  tyros segment 29
  CDS (1)..(90)
ggccataacagagagtcctacatggtgcctttcattcccctctacagaaacggagactttttcattagctccaaggatctgggatacgat

SEQ ID NO: 1028 - protein, 30 aa, Artificial
  tyros segment 29
GHNRESYMVPFIPLYRNGDFFISSKDLGYD

SEQ ID NO: 1029 - DNA, 90 bp, Artificial
  tyros segment 30
  CDS (1)..(90)
aggaatggcgatttctttatctccagcaaagacctcggctatgactatagctatctgcaagactccgaccctgactccttccaagactat

SEQ ID NO: 1030 - protein, 30 aa, Artificial
  tyros segment 30
RNGDFFISSKDLGYDYSYLQDSDPDSFQDY

SEQ ID NO: 1031 - DNA, 90 bp, Artificial
  tyros segment 31
  CDS (1)..(90)
tactcctacctccaggatagcgatcccgatagctttcaggattacattaagtcctacctcgagcaagcctccaggatttggtcctggctc

SEQ ID NO: 1032 - protein, 30 aa, Artificial
  tyros segment 31
YSYLQDSDPDSFQDYIKSYLEQASRIWSWL

SEQ ID NO: 1033 - DNA, 90 bp, Artificial
  tyros segment 32
  CDS (1)..(90)
atcaaaagctatctggaacaggctagcagaatctggagctggctgctcggcgctgccatggtgggagccgtcctgacagccctcctggct

SEQ ID NO: 1034 - protein, 30 aa, Artificial
  tyros segment 32
IKSYLEQASRIWSWLLGAAMVGAVLTALLA

SEQ ID NO: 1035 - DNA, 90 bp, Artificial
  tyros segment 33
  CDS (1)..(90)
ctgggagccgctatggtcggcgctgtgctcaccgctctgctcgccggactggtcagcctcctgtgtaggcataagagaaagcaactgcct

SEQ ID NO: 1036 - protein, 30 aa, Artificial
  tyros segment 33
LGAAMVGAVLTALLAGLVSLLCRHKRKQLP

SEQ ID NO: 1037 - DNA, 90 bp, Artificial
  tyros segment 34
  CDS (1)..(90)
ggcctcgtgtccctgctctgcagacacaaaaggaaacagctccccgaagagaaacagcctctgctcatggaaaaggaagactatcactcc

SEQ ID NO: 1038 - protein, 30 aa, Artificial
  tyros segment 34
GLVSLLCRHKRKQLPEEKQPLLMEKEDYHS

SEQ ID NO: 1039 - DNA, 69 bp, Artificial
  tyros segment 35
  CDS (1)..(69)
gaggaaaagcaacccctcctgatggagaaagaggattaccatagcctctaccaaagccatctggctgcc

SEQ ID NO: 1040 - protein, 23 aa, Artificial
  tyros segment 35
EEKQPLLMEKEDYHSLYQSHLAA

SEQ ID NO: 1041 - DNA, 90 bp, Artificial
  trp2 segment 1
  CDS (1)..(90)
gccgctatgtcccccctctggtggggctttctgctcagctgtctgggatgcaaaatcctccccggagcccaaggccaattccctagggtc

SEQ ID NO: 1042 - protein, 30 aa, Artificial
  trp2 segment 1
AAMSPLWWGFLLSCLGCKILPGAQGQFPRV

SEQ ID NO: 1043 - DNA, 90 bp, Artificial
  trp2 segment 2
  CDS (1)..(90)
ggctgtaagattctgcctggcgctcagggacagtttcccagagtgtgtatgacagtggatagcctcgtgaataaggaatgctgtcccaga

SEQ ID NO: 1044 - protein, 30 aa, Artificial
  trp2 segment 2
GCKILPGAQGQFPRVCMTVDSLVNKECCPR

SEQ ID NO: 1045 - DNA, 90 bp, Artificial
  trp2 segment 3
  CDS (1)..(90)
tgcatgaccgtcgactccctggtcaacaaagagtgttgccctaggctcggcgctgagtccgccaatgtgtgtggctcccagcaaggcaga

SEQ ID NO: 1046 - protein, 30 aa, Artificial
  trp2 segment 3
CMTVDSLVNKECCPRLGAESANVCGSQQGR

SEQ ID NO: 1047 - DNA, 90 bp, Artificial
  trp2 segment 4
  CDS (1)..(90)
ctgggagccgaaagcgctaacgtctgcggaagccaacagggaaggggacagtgtaccgaagtgagagccgataccagaccctggagcgga

SEQ ID NO: 1048 - protein, 30 aa, Artificial
  trp2 segment 4
LGAESANVCGSQQGRGQCTEVRADTRPWSG

SEQ ID NO: 1049 - DNA, 90 bp, Artificial
  trp2 segment 5
  CDS (1)..(90)
ggccaatgcacagaggtcagggctgacacaaggccttggtccggcccttacattctgagaaaccaagacgatagggaactgtggcccaga

SEQ ID NO: 1050 - protein, 30 aa, Artificial
  trp2 segment 5
GQCTEVRADTRPWSGPYILRNQDDRELWPR

SEQ ID NO: 1051 - DNA, 90 bp, Artificial
  trp2 segment 6
  CDS (1)..(90)
ccctatatcctcaggaatcaggatgacagagagctctggcctaggaaattctttcacagaacctgtaagtgtaccggaaactttgccgga

SEQ ID NO: 1052 - protein, 30 aa, Artificial
  trp2 segment 6
PYILRNQDDRELWPRKFFHRTCKCTGNFAG

SEQ ID NO: 1053 - DNA, 90 bp, Artificial
  trp2 segment 7
  CDS (1)..(90)
aagtttttccataggacatgcaaatgcacaggcaatttcgctggctataactgtggcgattgcaaattcggatggacaggccctaactgt

SEQ ID NO: 1054 - protein, 30 aa, Artificial
  trp2 segment 7
KFFHRTCKCTGNFAGYNCGDCKFGWTGPNC

SEQ ID NO: 1055 - DNA, 90 bp, Artificial
  trp2 segment 8
  CDS (1)..(90)
tacaattgcggagactgtaagtttggctggaccggacccaattgcgaaaggaaaaagcctcccgtcatcagacagaatatccatagcctc

SEQ ID NO: 1056 - protein, 30 aa, Artificial
  trp2 segment 8
YNCGDCKFGWTGPNCERKKPPVIRQNIHSL

SEQ ID NO: 1057 - DNA, 90 bp, Artificial
  trp2 segment 9
  CDS (1)..(90)
gagagaaagaaaccccctgtgattaggcaaaacattcactccctgtccccccaagagagagagcaattcctcggcgctctggatctggct

SEQ ID NO: 1058 - protein, 30 aa, Artificial
  trp2 segment 9
ERKKPPVIRQNIHSLSPQEREQFLGALDLA

SEQ ID NO: 1059 - DNA, 90 bp, Artificial
  trp2 segment 10
  CDS (1)..(90)
agccctcaggaaagggaacagtttctgggagccctcgacctcgccaaaaagagagtgcatcccgattacgtcatcacaacccaacactgg

SEQ ID NO: 1060 - protein, 30 aa, Artificial
  trp2 segment 10
SPQEREQFLGALDLAKKRVHPDYVITTQHW

SEQ ID NO: 1061 - DNA, 90 bp, Artificial
  trp2 segment 11
  CDS (1)..(90)
aagaaaagggtccaccctgactatgtgattaccacacagcattggctcggcctcctgggacccaatggcacacagcctcagtttgccaat

SEQ ID NO: 1062 - protein, 30 aa, Artificial
  trp2 segment 11
KKRVHPDYVITTQHWLGLLGPNGTQPQFAN

SEQ ID NO: 1063 - DNA, 90 bp, Artificial
  trp2 segment 12
  CDS (1)..(90)
ctgggactgctcggccctaacggaacccaaccccaattcgctaactgtagcgtctacgatttctttgtgtggctgcattactatagcgtc

SEQ ID NO: 1064 - protein, 30 aa, Artificial
  trp2 segment 12
LGLLGPNGTQPQFANCSVYDFFVWLHYYSV

SEQ ID NO: 1065 - DNA, 90 bp, Artificial
  trp2 segment 13
  CDS (1)..(90)
tgctccgtgtatgactttttcgtctggctccactattactccgtgagagacacactgctcggccctggcagaccctatagggctatcgat

SEQ ID NO: 1066 - protein, 30 aa, Artificial
  trp2 segment 13
CSVYDFFVWLHYYSVRDTLLGPGRPYRAID

SEQ ID NO: 1067 - DNA, 90 bp, Artificial
  trp2 segment 14
  CDS (1)..(90)
agggataccctcctgggacccggaaggccttacagagccattgactttagccatcagggacccgctttcgtcacctggcacagataccat

SEQ ID NO: 1068 - protein, 30 aa, Artificial
  trp2 segment 14
RDTLLGPGRPYRAIDFSHQGPAFVTWHRYH

SEQ ID NO: 1069 - DNA, 90 bp, Artificial
  trp2 segment 15
  CDS (1)..(90)
ttctcccaccaaggccctgcctttgtgacatggcataggtatcacctcctgtgtctggaaagggatctgcaaaggctcatcggaaacgaa

SEQ ID NO: 1070 - protein, 30 aa, Artificial
  trp2 segment 15
FSHQGPAFVTWHRYHLLCLERDLQRLIGNE

SEQ ID NO: 1071 - DNA, 90 bp, Artificial
  trp2 segment 16
  CDS (1)..(90)
ctgctctgcctcgagagagacctccagagactgattggcaatgagtccttcgctctgccttactggaactttgccacaggcagaaacgaa

SEQ ID NO: 1072 - protein, 30 aa, Artificial
  trp2 segment 16
LLCLERDLQRLIGNESFALPYWNFATGRNE

SEQ ID NO: 1073 - DNA, 90 bp, Artificial
  trp2 segment 17
  CDS (1)..(90)
agctttgccctcccctattggaatttcgctaccggaaggaatgagtgtgacgtctgcacagaccaactgtttggcgctgccagacccgat

SEQ ID NO: 1074 - protein, 30 aa, Artificial
  trp2 segment 17
SFALPYWNFATGRNECDVCTDQLFGAARPD

SEQ ID NO: 1075 - DNA, 90 bp, Artificial
  trp2 segment 18
  CDS (1)..(90)
tgcgatgtgtgtaccgatcagctcttcggagccgctaggcctgacgatcccacactgattagcagaaactccaggtttagctcctgggaa

SEQ ID NO: 1076 - protein, 30 aa, Artificial
  trp2 segment 18
CDVCTDQLFGAARPDDPTLISRNSRFSSWE

SEQ ID NO: 1077 - DNA, 90 bp, Artificial
  trp2 segment 19
  CDS (1)..(90)
gaccctaccctcatctccaggaatagcagattctccagctgggagacagtgtgtgactccctggatgactataaccatctggtcaccctc

SEQ ID NO: 1078 - protein, 30 aa, Artificial
  trp2 segment 19
DPTLISRNSRFSSWETVCDSLDDYNHLVTL

SEQ ID NO: 1079 - DNA, 90 bp, Artificial
  trp2 segment 20
  CDS (1)..(90)
accgtctgcgatagcctcgacgattacaatcacctcgtgacactgtgtaacggaacctatgagggactgctcaggagaaaccaaatggga

SEQ ID NO: 1080 - protein, 30 aa, Artificial
  trp2 segment 20
TVCDSLDDYNHLVTLCNGTYEGLLRRNQMG

SEQ ID NO: 1081 - DNA, 90 bp, Artificial
  trp2 segment 21
  CDS (1)..(90)
tgcaatggcacatacgaaggcctcctgagaaggaatcagatgggcagaaactccatgaaactgcctaccctcaaggatatcagagactgt

SEQ ID NO: 1082 - protein, 30 aa, Artificial
  trp2 segment 21
CNGTYEGLLRRNQMGRNSMKLPTLKDIRDC

SEQ ID NO: 1083 - DNA, 90 bp, Artificial
  trp2 segment 22
  CDS (1)..(90)
aggaatagcatgaagctccccacactgaaagacattagggattgcctcagcctccagaaattcgataaccctccctttttccaaaactcc

SEQ ID NO: 1084 - protein, 30 aa, Artificial
  trp2 segment 22
RNSMKLPTLKDIRDCLSLQKFDNPPFFQNS

SEQ ID NO: 1085 - DNA, 90 bp, Artificial
  trp2 segment 23
  CDS (1)..(90)
ctgtccctgcaaaagtttgacaatccccctttctttcagaatagcacattctccttcagaaacgctctggaaggctttgacaaagccgat

SEQ ID NO: 1086 - protein, 30 aa, Artificial
  trp2 segment 23
LSLQKFDNPPFFQNSTFSFRNALEGFDKAD

SEQ ID NO: 1087 - DNA, 90 bp, Artificial
  trp2 segment 24
  CDS (1)..(90)
acctttagctttaggaatgccctcgagggattcgataaggctgacggaaccctcgactcccaggtcatgtccctgcataacctcgtgcat

SEQ ID NO: 1088 - protein, 30 aa, Artificial
  trp2 segment 24
TFSFRNALEGFDKADGTLDSQVMSLHNLVH

SEQ ID NO: 1089 - DNA, 90 bp, Artificial
  trp2 segment 25
  CDS (1)..(90)
ggcacactggatagccaagtgatgagcctccacaatctggtccactccttcctcaacggaaccaatgccctcccccatagcgctgccaat

SEQ ID NO: 1090 - protein, 30 aa, Artificial
  trp2 segment 25
GTLDSQVMSLHNLVHSFLNGTNALPHSAAN

SEQ ID NO: 1091 - DNA, 90 bp, Artificial
  trp2 segment 26
  CDS (1)..(90)
agctttctgaatggcacaaacgctctgcctcactccgccgctaacgatcccattttcgtcgtgctccactccttcacagacgctatcttt

SEQ ID NO: 1092 - protein, 30 aa, Artificial
  trp2 segment 26
SFLNGTNALPHSAANDPIFVVLHSFTDAIF

SEQ ID NO: 1093 - DNA, 90 bp, Artificial
  trp2 segment 27
  CDS (1)..(90)
gaccctatctttgtggtcctgcatagctttaccgatgccattttcgatgagtggatgaaaaggtttaaccctcccgctgacgcttggcct

SEQ ID NO: 1094 - protein, 30 aa, Artificial
  trp2 segment 27
DPIFVVLHSFTDAIFDEWMKRFNPPADAWP

SEQ ID NO: 1095 - DNA, 90 bp, Artificial
  trp2 segment 28
  CDS (1)..(90)
gacgaatggatgaagagattcaatccccctgccgatgcctggccccaagagctcgcccctatcggacacaataggatgtacaatatggtc

SEQ ID NO: 1096 - protein, 30 aa, Artificial
  trp2 segment 28
DEWMKRFNPPADAWPQELAPIGHNRMYNMV

SEQ ID NO: 1097 - DNA, 90 bp, Artificial
  trp2 segment 29
  CDS (1)..(90)
caggaactggctcccattggccataacagaatgtataacatggtgcctttctttccccctgtgacaaacgaagagctcttcctcacctcc

SEQ ID NO: 1098 - protein, 30 aa, Artificial
  trp2 segment 29
QELAPIGHNRMYNMVPFFPPVTNEELFLTS

SEQ ID NO: 1099 - DNA, 90 bp, Artificial
  trp2 segment 30
  CDS (1)..(90)
ccctttttccctcccgtcaccaatgaggaactgtttctgacaagcgatcagctcggctatagctatgccattgacctccccgtcagcgtc

SEQ ID NO: 1100 - protein, 30 aa, Artificial
  trp2 segment 30
PFFPPVTNEELFLTSDQLGYSYAIDLPVSV

SEQ ID NO: 1101 - DNA, 90 bp, Artificial
  trp2 segment 31
  CDS (1)..(90)
gaccaactgggatactcctacgctatcgatctgcctgtgtccgtggaagagacacccggatggcctaccacactgctcgtggtcatggga

SEQ ID NO: 1102 - protein, 30 aa, Artificial
  trp2 segment 31
DQLGYSYAIDLPVSVEETPGWPTTLLVVMG

SEQ ID NO: 1103 - DNA, 90 bp, Artificial
  trp2 segment 32
  CDS (1)..(90)
gaggaaacccctggctggcccacaaccctcctggtcgtgatgggcacactggtcgccctcgtgggactgtttgtgctcctggctttcctc

SEQ ID NO: 1104 - protein, 30 aa, Artificial
  trp2 segment 32
EETPGWPTTLLVVMGTLVALVGLFVLLAFL

SEQ ID NO: 1105 - DNA, 90 bp, Artificial
  trp2 segment 33
  CDS (1)..(90)
accctcgtggctctggtcggcctcttcgtcctgctcgcctttctgcaatacagaaggctcaggaaaggctatacccctctgatggagaca

SEQ ID NO: 1106 - protein, 30 aa, Artificial
  trp2 segment 33
TLVALVGLFVLLAFLQYRRLRKGYTPLMET

SEQ ID NO: 1107 - DNA, 84 bp, Artificial
  trp2 segment 34
  CDS (1)..(84)
cagtataggagactgagaaagggatacacacccctcatggaaacccatctgtccagcaaaaggtataccgaagaggctgccgct

SEQ ID NO: 1108 - protein, 28 aa, Artificial
  trp2 segment 34
QYRRLRKGYTPLMETHLSSKRYTEEAAA

SEQ ID NO: 1109 - DNA, 90 bp, Artificial
  MC1R segment 1
  CDS (1)..(90)
gccgctatggctgtgcaaggctcccagagaaggctcctgggaagcctcaactccacccctaccgctatccctcagctcggcctcgccgct

SEQ ID NO: 1110 - protein, 30 aa, Artificial
  MC1R segment 1
AAMAVQGSQRRLLGSLNSTPTAIPQLGLAA

SEQ ID NO: 1111 - DNA, 90 bp, Artificial
  MC1R segment 2
  CDS (1)..(90)
ctgaatagcacacccacagccattccccaactgggactggctgccaatcagacaggcgctaggtgtctggaagtgtccatctccgacgga

SEQ ID NO: 1112 - protein, 30 aa, Artificial
  MC1R segment 2
LNSTPTAIPQLGLAANQTGARCLEVSISDG

SEQ ID NO: 1113 - DNA, 90 bp, Artificial
  MC1R segment 3
  CDS (1)..(90)
aaccaaaccggagccagatgcctcgaggtcagcattagcgatggcctcttcctcagcctcggcctcgtgtccctggtcgagaatgccctc

SEQ ID NO: 1114 - protein, 30 aa, Artificial
  MC1R segment 3
NQTGARCLEVSISDGLFLSLGLVSLVENAL

SEQ ID NO: 1115 - DNA, 90 bp, Artificial
  MC1R segment 4
  CDS (1)..(90)
ctgtttctgtccctgggactggtcagcctcgtggaaaacgctctggtcgtggctaccattgccaaaaacagaaacctccactcccccatg

SEQ ID NO: 1116 - protein, 30 aa, Artificial
  MC1R segment 4
LFLSLGLVSLVENALVVATIAKNRNLHSPM

SEQ ID NO: 1117 - DNA, 90 bp, Artificial
  MC1R segment 5
  CDS (1)..(90)
gtggtcgccacaatcgctaagaataggaatctgcatagccctatgtattgctttatctgttgcctcgccctcagcgatctgctcgtgtcc

SEQ ID NO: 1118 - protein, 30 aa, Artificial
  MC1R segment 5
VVATIAKNRNLHSPMYCFICCLALSDLLVS

SEQ ID NO: 1119 - DNA, 90 bp, Artificial
  MC1R segment 6
  CDS (1)..(90)
tactgtttcatttgctgtctggctctgtccgacctcctggtcagcggaaccaatgtgctcgagacagccgtcatcctcctgctcgaggct

SEQ ID NO: 1120 - protein, 30 aa, Artificial
  MC1R segment 6
YCFICCLALSDLLVSGTNVLETAVILLLEA

SEQ ID NO: 1121 - DNA, 90 bp, Artificial
  MC1R segment 7
  CDS (1)..(90)
ggcacaaacgtcctggaaaccgctgtgattctgctcctggaagccggagccctcgtggctagggctgccgtcctgcaacagctcgacaat

SEQ ID NO: 1122 - protein, 30 aa, Artificial
  MC1R segment 7
GTNVLETAVILLLEAGALVARAAVLQQLDN

SEQ ID NO: 1123 - DNA, 90 bp, Artificial
  MC1R segment 8
  CDS (1)..(90)
ggcgctctggtcgccagagccgctgtgctccagcaactggataacgtcatcgatgtgattacctgtagctccatgctcagctccctgtgt

SEQ ID NO: 1124 - protein, 30 aa, Artificial
  MC1R segment 8
GALVARAAVLQQLDNVIDVITCSSMLSSLC

SEQ ID NO: 1125 - DNA, 90 bp, Artificial
  MC1R segment 9
  CDS (1)..(90)
gtgattgacgtcatcacatgctccagcatgctgtccagcctctgctttctgggagccattgccgtcgacagatacattagcattttctat

SEQ ID NO: 1126 - protein, 30 aa, Artificial
  MC1R segment 9
VIDVITCSSMLSSLCFLGAIAVDRYISIFY

SEQ ID NO: 1127 - DNA, 90 bp, Artificial
  MC1R segment 10
  CDS (1)..(90)
ttcctcggcgctatcgctgtggataggtatatctccatcttttacgctctgagataccatagcattgtgacactgcctagggctcccaga

SEQ ID NO: 1128 - protein, 30 aa, Artificial
  MC1R segment 10
FLGAIAVDRYISIFYALRYHSIVTLPRAPR

SEQ ID NO: 1129 - DNA, 90 bp, Artificial
  MC1R segment 11
  CDS (1)..(90)
gccctcaggtatcactccatcgtcaccctccccagagcccctagggctgtggctgccatttgggtcgcctccgtggtcttctccaccctc

SEQ ID NO: 1130 - protein, 30 aa, Artificial
  MC1R segment 11
ALRYHSIVTLPRAPRAVAAIWVASVVFSTL

SEQ ID NO: 1131 - DNA, 90 bp, Artificial
  MC1R segment 12
  CDS (1)..(90)
gccgtcgccgctatctgggtggctagcgtcgtgtttagcacactgtttatcgcttactatgaccatgtggctgtgctcctgtgtctggtc

SEQ ID NO: 1132 - protein, 30 aa, Artificial
  MC1R segment 12
AVAAIWVASVVFSTLFIAYYDHVAVLLCLV

SEQ ID NO: 1133 - DNA, 90 bp, Artificial
  MC1R segment 13
  CDS (1)..(90)
ttcattgcctattacgatcacgtcgccgtcctgctctgcctcgtggtcttctttctggctatgctcgtgctcatggctgtgctctacgtc

SEQ ID NO: 1134 - protein, 30 aa, Artificial
  MC1R segment 13
FIAYYDHVAVLLCLVVFFLAMLVLMAVLYV

SEQ ID NO: 1135 - DNA, 90 bp, Artificial
  MC1R segment 14
  CDS (1)..(90)
gtgtttttcctcgccatgctggtcctgatggccgtcctgtatgtgcatatgctcgccagagcctgtcagcatgcccaaggcattgccaga

SEQ ID NO: 1136 - protein, 30 aa, Artificial
  MC1R segment 14
VFFLAMLVLMAVLYVHMLARACQHAQGIAR

SEQ ID NO: 1137 - DNA, 90 bp, Artificial
  MC1R segment 15
  CDS (1)..(90)
cacatgctggctagggcttgccaacacgctcagggaatcgctaggctccacaaaaggcaaaggcctgtgcatcagggattcggactgaaa

SEQ ID NO: 1138 - protein, 30 aa, Artificial
  MC1R segment 15
HMLARACQHAQGIARLHKRQRPVHQGFGLK

SEQ ID NO: 1139 - DNA, 90 bp, Artificial
  MC1R segment 16
  CDS (1)..(90)
ctgcataagagacagagacccgtccaccaaggctttggcctcaagggagccgtcaccctcaccattctgctcggcattttctttctgtgt

SEQ ID NO: 1140 - protein, 30 aa, Artificial
  MC1R segment 16
LHKRQRPVHQGFGLKGAVTLTILLGIFFLC

SEQ ID NO: 1141 - DNA, 90 bp, Artificial
  MC1R segment 17
  CDS (1)..(90)
ggcgctgtgacactgacaatcctcctgggaatctttttcctctgctggggccctttctttctgcatctgacactgattgtgctctgccct

SEQ ID NO: 1142 - protein, 30 aa, Artificial
  MC1R segment 17
GAVTLTILLGIFFLCWGPFFLHLTLIVLCP

SEQ ID NO: 1143 - DNA, 90 bp, Artificial
  MC1R segment 18
  CDS (1)..(90)
tggggaccctttttcctccacctcaccctcatcgtcctgtgtcccgaacaccctacctgtggctgtatctttaagaatttcaatctgttt

SEQ ID NO: 1144 - protein, 30 aa, Artificial
  MC1R segment 18
WGPFFLHLTLIVLCPEHPTCGCIFKNFNLF

SEQ ID NO: 1145 - DNA, 90 bp, Artificial
  MC1R segment 19
  CDS (1)..(90)
gagcatcccacatgcggatgcattttcaaaaactttaacctcttcctcgccctcatcatttgcaatgccattatcgatcccctcatctat

SEQ ID NO: 1146 - protein, 30 aa, Artificial
  MC1R segment 19
EHPTCGCIFKNFNLFLALIICNAIIDPLIY

SEQ ID NO: 1147 - DNA, 90 bp, Artificial
  MC1R segment 20
  CDS (1)..(90)
ctggctctgattatctgtaacgctatcattgaccctctgatttacgctttccatagccaagagctcaggagaaccctcaaggaagtgctc

SEQ ID NO: 1148 - protein, 30 aa, Artificial
  MC1R segment 20
LALIICNAIIDPLIYAFHSQELRRTLKEVL

SEQ ID NO: 1149 - DNA, 63 bp, Artificial
  MC1R segment 21
  CDS (1)..(63)
gcctttcactcccaggaactgagaaggacactgaaagaggtcctgacatgctcctgggctgcc

SEQ ID NO: 1150 - protein, 21 aa, Artificial
  MC1R segment 21
AFHSQELRRTLKEVLTCSWAA

SEQ ID NO: 1151 - DNA, 90 bp, Artificial
  MUC1F segment 1
  CDS (1)..(90)
gccgctatgacacccggaacccaaagccctttctttctgctcctgctcctgacagtgctcaccgtcgtgacaggctccggccatgcctcc

SEQ ID NO: 1152 - protein, 30 aa, Artificial
  MUC1F segment 1
AAMTPGTQSPFFLLLLLTVLTVVTGSGHAS

SEQ ID NO: 1153 - DNA, 90 bp, Artificial
  MUC1F segment 2
  CDS (1)..(90)
ctgctcaccgtcctgacagtggtcaccggaagcggacacgctagctccacccctggcggagagaaagagacaagcgctacccaaaggtcc

SEQ ID NO: 1154 - protein, 30 aa, Artificial
  MUC1F segment 2
LLTVLTVVTGSGHASSTPGGEKETSATQRS

SEQ ID NO: 1155 - DNA, 90 bp, Artificial
  MUC1F segment 3
  CDS (1)..(90)
agcacacccggaggcgaaaaggaaacctccgccacacagagaagctccgtgcctagctccaccgaaaagaatgccgtcagcatgacctcc

SEQ ID NO: 1156 - protein, 30 aa, Artificial
  MUC1F segment 3
STPGGEKETSATQRSSVPSSTEKNAVSMTS

SEQ ID NO: 1157 - DNA, 90 bp, Artificial
  MUC1F segment 4
  CDS (1)..(90)
agcgtcccctccagcacagagaaaaacgctgtgtccatgacaagctccgtgctcagctcccactcccccggaagcggaagctccaccaca

SEQ ID NO: 1158 - protein, 30 aa, Artificial
  MUC1F segment 4
SVPSSTEKNAVSMTSSVLSSHSPGSGSSTT

SEQ ID NO: 1159 - DNA, 90 bp, Artificial
  MUC1F segment 5
  CDS (1)..(90)
agcgtcctgtccagccatagccctggctccggctccagcacaacccaaggccaagacgtcaccctcgcccctgccacagagcctgcctcc

SEQ ID NO: 1160 - protein, 30 aa, Artificial
  MUC1F segment 5
SVLSSHSPGSGSSTTQGQDVTLAPATEPAS

SEQ ID NO: 1161 - DNA, 90 bp, Artificial
  MUC1F segment 6
  CDS (1)..(90)
cagggacaggatgtgacactggctcccgctaccgaacccgctagcggaagcgctgccacatggggacaggatgtgacaagcgtccccgtc

SEQ ID NO: 1162 - protein, 30 aa, Artificial
  MUC1F segment 6
QGQDVTLAPATEPASGSAATWGQDVTSVPV

SEQ ID NO: 1163 - DNA, 90 bp, Artificial
  MUC1F segment 7
  CDS (1)..(90)
ggctccgccgctacctggggccaagacgtcacctccgtgcctgtgacaaggcctgccctcggctccaccacaccccctgcccatgacgtc

SEQ ID NO: 1164 - protein, 30 aa, Artificial
  MUC1F segment 7
GSAATWGQDVTSVPVTRPALGSTTPPAHDV

SEQ ID NO: 1165 - DNA, 72 bp, Artificial
  MUC1F segment 8
  CDS (1)..(72)
accagacccgctctgggaagcacaacccctcccgctcacgatgtgacaagcgctcccgataacaaagccgct

SEQ ID NO: 1166 - protein, 24 aa, Artificial [sequence omitted]

SEQ ID NO: 1167 - DNA, 90 bp, Artificial
  MUC1R segment 1
  CDS (1)..(90)
gccgctaacagacccgctctgggaagcacagcccctcccgtccacaatgtgacaagcgctagcggaagcgctagcggaagcgctagcaca

SEQ ID NO: 1168 - protein, 30 aa, Artificial
  MUC1R segment 1
AANRPALGSTAPPVHNVTSASGSASGSAST

SEQ ID NO: 1169 - DNA, 90 bp, Artificial
  MUC1R segment 2
  CDS (1)..(90)
aacgtcacctccgcctccggctccgcctccggctccgcctccaccctcgtgcataacggaacctccgccagagccacaaccacacccgct

SEQ ID NO: 1170 - protein, 30 aa, Artificial
  MUC1R segment 2
NVTSASGSASGSASTLVHNGTSARATTTPA

SEQ ID NO: 1171 - DNA, 90 bp, Artificial
  MUC1R segment 3
  CDS (1)..(90)
ctggtccacaatggcacaagcgctagggctaccacaacccctgcctccaagtccacccctttctccatccctagccatcactccgacaca

SEQ ID NO: 1172 - protein, 30 aa, Artificial
  MUC1R segment 3
LVHNGTSARATTTPASKSTPFSIPSHHSDT

SEQ ID NO: 1173 - DNA, 90 bp, Artificial
  MUC1R segment 4
  CDS (1)..(90)
agcaaaagcacaccctttagcattccctcccaccatagcgatacccctaccacactggctagccatagcacaaagacagacgctagctcc

SEQ ID NO: 1174 - protein, 30 aa, Artificial
  MUC1R segment 4
SKSTPFSIPSHHSDTPTTLASHSTKTDASS

SEQ ID NO: 1175 - DNA, 90 bp, Artificial
  MUC1R segment 5
  CDS (1)..(90)
cccacaaccctcgcctcccactccaccaaaaccgatgcctccagcacacaccatagctccgtgcctcccctcacctccagcaatcactcc

SEQ ID NO: 1176 - protein, 30 aa, Artificial
  MUC1R segment 5
PTTLASHSTKTDASSTHHSSVPPLTSSNHS

SEQ ID NO: 1177 - DNA, 90 bp, Artificial
  MUC1R segment 6
  CDS (1)..(90)
acccatcactccagcgtcccccctctgacaagctccaaccatagcacaagccctcagctcagcacaggcgtcagctttttctttctgtcc

SEQ ID NO: 1178 - protein, 30 aa, Artificial
  MUC1R segment 6
THHSSVPPLTSSNHSTSPQLSTGVSFFFLS

SEQ ID NO: 1179 - DNA, 90 bp, Artificial
  MUC1R segment 7
  CDS (1)..(90)
acctccccccaactgtccaccggagtgtccttctttttcctcagctttcacattagcaatctgcaattcaatagctccctggaagaccct

SEQ ID NO: 1180 - protein, 30 aa, Artificial
  MUC1R segment 7
TSPQLSTGVSFFFLSFHISNLQFNSSLEDP

SEQ ID NO: 1181 - DNA, 90 bp, Artificial
  MUC1R segment 8
  CDS (1)..(90)
ttccatatctccaacctccagtttaactccagcctcgaggatccctccaccgattactatcaggaactgcaaagggatatctccgagatg

SEQ ID NO: 1182 - protein, 30 aa, Artificial
  MUC1R segment 8
FHISNLQFNSSLEDPSTDYYQELQRDISEM

SEQ ID NO: 1183 - DNA, 90 bp, Artificial
  MUC1R segment 9
  CDS (1)..(90)
agcacagactattaccaagagctccagagagacattagcgaaatgtttctgcaaatctataagcaaggcggattcctcggcctcagcaat

SEQ ID NO: 1184 - protein, 30 aa, Artificial
  MUC1R segment 9
STDYYQELQRDISEMFLQIYKQGGFLGLSN

SEQ ID NO: 1185 - DNA, 90 bp, Artificial
  MUC1R segment 10
  CDS (1)..(90)
ttcctccagatttacaaacagggaggctttctgggactgtccaacattaagtttaggcctggctccgtggtcgtgcaactgacactggct

SEQ ID NO: 1186 - protein, 30 aa, Artificial
  MUC1R segment 10
FLQIYKQGGFLGLSNIKFRPGSVVVQLTLA

SEQ ID NO: 1187 - DNA, 90 bp, Artificial
  MUC1R segment 11
  CDS (1)..(90)
atcaaattcagacccggaagcgtcgtggtccagctcaccctcgcctttagggaaggcacaatcaatgtgcatgacgtcgagacacagttt

SEQ ID NO: 1188 - protein, 30 aa, Artificial
  MUC1R segment 11
IKFRPGSVVVQLTLAFREGTINVHDVETQF

SEQ ID NO: 1189 - DNA, 90 bp, Artificial
  MUC1R segment 12
  CDS (1)..(90)
ttcagagagggaaccattaacgtccacgatgtggaaacccaattcaatcagtataagacagaggctgcctccaggtataacctcaccatt

SEQ ID NO: 1190 - protein, 30 aa, Artificial
  MUC1R segment 12
FREGTINVHDVETQFNQYKTEAASRYNLTI

SEQ ID NO: 1191 - DNA, 90 bp, Artificial
  MUC1R segment 13
  CDS (1)..(90)
aaccaatacaaaaccgaagccgctagcagatacaatctgacaatctccgacgtcagcgtcagcgatgtgcctttccctttctccgcccaa

SEQ ID NO: 1192 - protein, 30 aa, Artificial
  MUC1R segment 13
NQYKTEAASRYNLTISDVSVSDVPFPFSAQ

SEQ ID NO: 1193 - DNA, 90 bp, Artificial
  MUC1R segment 14
  CDS (1)..(90)
agcgatgtgtccgtgtccgacgtcccctttccctttagcgctcagtccggcgctggcgtccccggatggggaatcgctctgctcgtgctc

SEQ ID NO: 1194 - protein, 30 aa, Artificial
  MUC1R segment 14
SDVSVSDVPFPFSAQSGAGVPGWGIALLVL

SEQ ID NO: 1195 - DNA, 90 bp, Artificial
  MUC1R segment 15
  CDS (1)..(90)
agcggagccggagtgcctggctggggcattgccctcctggtcctggtctgcgtcctggtcgccctcgccattgtgtatctgattgccctc

SEQ ID NO: 1196 - protein, 30 aa, Artificial
  MUC1R segment 15
SGAGVPGWGIALLVLVCVLVALAIVYLIAL

SEQ ID NO: 1197 - DNA, 90 bp, Artificial
  MUC1R segment 16
  CDS (1)..(90)
gtgtgtgtgctcgtggctctggctatcgtctacctcatcgctctggctgtgtgtcagtgtaggagaaagaattacggacagctcgacatt

SEQ ID NO: 1198 - protein, 30 aa, Artificial
  MUC1R segment 16
VCVLVALAIVYLIALAVCQCRRKNYGQLDI

SEQ ID NO: 1199 - DNA, 90 bp, Artificial
  MUC1R segment 17
  CDS (1)..(90)
gccgtctgccaatgcagaaggaaaaactatggccaactggatatctttcccgctagggatacctatcaccctatgtccgagtatcccaca

SEQ ID NO: 1200 - protein, 30 aa, Artificial
  MUC1R segment 17
AVCQCRRKNYGQLDIFPARDTYHPMSEYPT

SEQ ID NO: 1201 - DNA, 90 bp, Artificial
  MUC1R segment 18
  CDS (1)..(90)
ttccctgccagagacacataccatcccatgagcgaataccctacctatcacacacacggaaggtatgtgcctccctccagcacagacaga

SEQ ID NO: 1202 - protein, 30 aa, Artificial
  MUC1R segment 18
FPARDTYHPMSEYPTYHTHGRYVPPSSTDR

SEQ ID NO: 1203 - DNA, 90 bp, Artificial
  MUC1R segment 19
  CDS (1)..(90)
taccatacccatggcagatacgtcccccctagctccaccgataggtccccctatgagaaagtgtccgccggaaacggaggctccagcctc

SEQ ID NO: 1204 - protein, 30 aa, Artificial
  MUC1R segment 19
YHTHGRYVPPSSTDRSPYEKVSAGNGGSSL

SEQ ID NO: 1205 - DNA, 90 bp, Artificial
  MUC1R segment 20
  CDS (1)..(90)
agcccttacgaaaaggtcagcgctggcaatggcggaagctccctgtcctacacaaaccctgccgtcgccgctgcctccgccaatctggct

SEQ ID NO: 1206 - protein, 30 aa, Artificial
  MUC1R segment 20
SPYEKVSAGNGGSSLSYTNPAVAAASANLA

SEQ ID NO: 1207 - DNA, 48 bp, Artificial
  MUC1R segment 21
  CDS (1)..(48)
agctataccaatcccgctgtggctgccgctagcgctaacctcgccgct

SEQ ID NO: 1208 - protein, 16 aa, Artificial
  MUC1R segment 21
SYTNPAVAAASANLAA

SEQ ID NO: 1209 - DNA, 16638 bp, Artificial
  Differentiation svaine
  CDS (1)..(16638)
tggaataggcaactgtatcccgaatggacagaggctcagagactggattgctggaggggaggccaagtgtccctgaaagtgtccaacgatccctatatcctcaggaatcaggatgacagagagctctggcctaggaaattctttcacagaacctgtaagtgtaccggaaactttgccggaaggaatggcgatttctttatctccagcaaagacctcggctatgactatagctatctgcaagactccgaccctgactccttccaagactatgccgctcccgctttcctcacctggcacagataccatctgctcaggctcgagaaagacatgcaggaaatgctccaggaaccctccttctccggccataacagagagtcctacatggtgcctttcattcccctctacagaaacggagactttttcattagctccaaggatctgggatacgatctgctctgcctcgagagagacctccagagactgattggcaatgagtccttcgctctgccttactggaactttgccacaggcagaaacgaaaccacagaggtcgtgggaaccacacccggacaggctcccacagccgaaccctccggcacaacctccgtgcaagtgcctaccacagaggtcagcacagactattaccaagagctccagagagacattagcgaaatgtttctgcaaatctataagcaaggcggattcctcggcctcagcaatgcctgtatggaaatctccagccctggctgtcagcctcccgctcagagactgtgtcagcctgtgctcccctcccccgcttgccaactggtcgaccaactgggatactcctacgctatcgatctgcctgtgtccgtggaagagacacccggatggcctaccacactgctcgtggtcatgggaaccgaagacggacccattaggagaaaccctgccggaaacgtcgccagacccatggtgcaaaggctccccgaaccccaagacgtcgcccaatgcatgaccgtcgactccctggtcaacaaagagtgttgccctaggctcggcgctgagtccgccaatgtgtgtggctcccagcaaggcagaaaccaatacaaaaccgaagccgctagcagatacaatctgacaatctccgacgtcagcgtcagcgatgtgcctttccctttctccgcccaagccgctatgtcccccctctggtggggctttctgctcagctgtctgggatgcaaaatcctccccggagcccaaggccaattccctagggtcgccgatctgtcctacacatgggatttcggagactccagcggaaccctcatctccagggctctggtcgtgacacacacatacctcgagcctctggctgagatgagcacacccgaagccacaggcatgacccctgccgaagtgtccatcgtcgtgctcagcggaaccacagccgctcaggtcatcaaattcagacccggaagcgtcgtggtccagctcaccctcgcctttagggaaggcacaatcaatgtgcatgacgtcgagacacagtttggctccgccgctacctggggccaagacgtcacctccgtgcctgtgacaaggcctgccctcggctccaccacaccccctgcccatgacgtcctgcataagagacagagacccgtccaccaaggctttggcctcaagggagccgtcaccctcaccattctgctcggcattttctttctgtgtctggctctgattatctgtaacgctatcattgaccctctgatttacgctttccatagccaagagctcaggagaaccctcaaggaagtgctcaagtttttccataggacatgcaaatgcacaggcaatttcgctggctataactgtggcgattgcaaattcggatggacaggccctaactgtctgtccctgcaaaagtttgacaatccccctttctttcagaatagcacattctccttcagaaacgctctggaaggctttgacaaagccgatagcaaaagcacaccctttagcattccctcccaccatagcgatacccctaccacactggctagccatagcacaaagacagacgctagctccgccgctaacagacccgctctgggaagcacagcccctcccgtccacaatgtgacaagcgctagcggaagcgctagcggaagcgctagcacatgcaatggcacatacgaaggcctcctgagaaggaatcagatgggcagaaactccatgaaactgcctaccctcaaggatatcagagactgtacccatcactccagcgtcccccctctgacaagctccaaccatagcacaagccctcagctcagcacaggcgtcagctttttctttctgtccttcattgcctattacgatcacgtcgccgtcctgctctgcctcgtggtcttctttctggctatgctcgtgctcatggctgtgctctacgtcaagctcaccggagacgaaaactttaccattccctattgggattggagagacgctgagaaatgcgatatctgtaccgatgagtatatgggactgagactggtcaagagacaggtccccctcgactgtgtgctctacagatacggaagctttagcgtcaccctcgacattgtgcaaggcattttcctccagatttacaaacagggaggctttctgggactgtccaacattaagtttaggcctggctccgtggtcgtgcaactgacactggctgtgattgacgtcatcacatgctccagcatgctgtccagcctctgctttctgggagccattgccgtcgacagatacattagcattttctataggaatcccggaaaccatgacaaaagcagaacccctaggctcccctccagcgctgacgtcgagttttgcctcagcctcacccaatacgaattcgatgagtggctgagaaggtataacgctgacattagcacattccctctggaaaacgctcccattggccataacagacagtataacatggtgtccctggctgacacaaactccctggctgtggtcagcacacagctcatcatgcccggacaggaagccggactgggacaggtccccctcggccctgtgacagcccaagtggtcctgcaagccgctatccctctgacaagctgtggctccagccctgtgcctggcacaaccgatggccataagtttggcttttggggacccaattgcacagagagaaggctcctggtcaggagaaacattttcgatctgtccgcccctgagaaagacaaactgggaacccataccatggaggtcaccgtctaccataggagaggctccaggtcctacgtccccctcgcccatagctccagcgctttcacagccgtcgccgctatctgggtggctagcgtcgtgtttagcacactgtttatcgcttactatgaccatgtggctgtgctcctgtgtctggtcggcacactggatagccaagtgatgagcctccacaatctggtccactccttcctcaacggaaccaatgccctcccccatagcgctgccaatggctgttggtattgcagaaggagaaacggatacagagccctcatggataagtccctgcatgtgggaacccaatgcgctctgacaaggagaccctggcacagactgtttctgctcaggtgggagcaagagattcagaaactgacaggcgatgagaatttcacaatcccttactgggactgggccgctatggctgtgcaaggctcccagagaaggctcctgggaagcctcaactccacccctaccgctatccctcagctcggcctcgccgctgtggtcgccacaatcgctaagaataggaatctgcatagccctatgtattgctttatctgttgcctcgccctcagcgatctgctcgtgtcccagtccagcatgcacaatgccctccacatttacatgaacggaaccatgagccaagtgcaaggctccgccaatgaccctatctttctgctcggccaacaccctaccaatcccaatctgctcagccctgcctccttctttagctcctggcaaatcgtctgctccaggctcgaggaatacaattactgtttcatttgctgtctggctctgtccgacctcctggtcagcggaaccaatgtgctcgagacagccgtcatcctcctgctcgaggctgaccctaccctcatctccaggaatagcagattctccagctgggagacagtgtgtgactccctggatgactataaccatctggtcaccctcaccagacccgctctgggaagcacaacccctcccgctcacgatgtgacaagcgctcccgataacaaagccgctagggatgccgaaaagtgtgacatttgcacagacgaatacatgggcggacagcatcccacaaaccctaacctcctgtcccccgctagctttacctttgccctccagctccacgatccctccggctatctggctgaggctgacctcagctatacctgggactttggcgatagctccggcacaagctccgccgatgtggaattctgtctgtccctgacacagtatgagtccggctccatggataaggctgccaatttctccttcagaaacacaggccctaccctcatcggagccaatgcctccttctccatcgctctgaatttccctggctcccagaaagtgctccccgatggccaagtgatttggggaccctttttcctccacctcaccctcatcgtcctgtgtcccgaacaccctacctgtggctgtatctttaagaatttcaatctgttttgccaatgctccggcaatttcatgggctttaactgtggcaattgcaaattcggattctggggccctaactgtaccgaaaggagactgctccagtataggagactgagaaagggatacacacccctcatggaaacccatctgtccagcaaaaggtataccgaagaggctgccgctcccctcgagaatgcccctatcggacacaataggcaatacaatatggtccccttttggcctcccgtcaccaataccgaaatgtttgtgacaaactttcccggaagccaaaaggtcctgcctgacggacaggtcatctgggtgaataacacaatcattaacggaagccaagtgtggggcggaaggcctaccgctgaggctcccaataccacagccggacaggtccccacaaccgaagtggtcggcacaacccctggccaagcccctaccgctagcacacccggaggcgaaaaggaaacctccgccacacagagaagctccgtgcctagctccaccgaaaagaatgccgtcagcatgacctccctgatttacagaaggagactgatgaagcaagactttagcgtcccccaactgcctcactccagctcccactggctgagactgcctaggattctgggactgctcggccctaacggaacccaaccccaattcgctaactgtagcgtctacgatttctttgtgtggctgcattactatagcgtctgcctcgaggtcggcctcttcgatacccctcccttttactccaactccaccaatagctttaggaataccgtcgagggatactccgaccctgccgctatggatctggtcctgaaaaggtgtctgctccacctcgccgtcatcggagccctcctggctgtgggagccacaaaggtccccagaaaccaaaccggagccagatgcctcgaggtcagcattagcgatggcctcttcctcagcctcggcctcgtgtccctggtcgagaatgccctcagcggaagcatggacaaagccgctaactttagctttaggaataccctcgagggattcgctagccctctgacaggcattgccgatgcctccagcccttgcggacagctcagcggaaggggaagctgtcagaatatcctcctgtccaacgctcccctcggccctcagtttccctttaccggaatgcattactatgtgtccatggatgccctcctgggaggctccgagatttggagagacattgactttgcccatgaggctcccgctttcctcgaggaaaagcaacccctcctgatggagaaagaggattaccatagcctctaccaaagccatctggctgccggccaatgcacagaggtcagggctgacacaaggccttggtccggcccttacattctgagaaaccaagacgatagggaactgtggcccagaagcgtcccctccagcacagagaaaaacgctgtgtccatgacaagctccgtgctcagctcccactcccccggaagcggaagctccaccacaacccctatgtttaacgatatcaatatctatgacctcttcgtctggatgcactattacgtcagcatggacgctctgctcggcggaagcgaacagcctgtgtatccccaagagacagacgatgcctgtatctttcccgatggcggaccctgtccctccggctcctggtcccagaaaaggtccgactccctggaagactatgacacactgggaaccctctgcaatagcacagaggatggccctatcagaaggaatcccgctggcaatgtggcttgggtcaacaataccattatcaatggctcccaggtctggggaggccaacccgtctaccctcaggaaaccgatgacgcttgcattttccctcaggaaaagaattgcgaacccgtcgtgcctaacgctccccctgcctatgagaaactgtccgccgaacagtccccccctccctatagccctagcagaagctatgtgcctctggctcactccagctccgcctttaccattaccgatcaggtcccctttagcgtcagcgtcagccaactgagactggaaaaggatatgcaagagatgctgcaagagcctagctttagcctcccctattggaatttcgctaccggaaagaatgtgtgtgacattgtgcctttctggccccctgtgacaaacacagagatgttcgtcaccgctcccgataacctcggctatacctatgaggctgcctgctccgtgtatgactttttcgtctggctccactattactccgtgagagacacactgctcggccctggcagaccctatagggctatcgatgtgagaaggaatatctttgacctcagcgctcccgaaaaggataagtttttcgcttacctcaccctcgccaaacacacaatctccagcgataagaaaggccatggccatagctataccacagccgaagaggctgccggaatcggaatcctcaccgtcatcctcggcgtcctgctcctgattttcgtctacgtctggaaaacctggggccaatactggcaggtcctgggaggccctgtgtccggcctcagcattggcacaggcagagccatgggcggacccgtcagcggactgtccatcggaaccggaagggctatgctcggcacacacacaatggaagtgacagtgtatcacagaaggggaatctccaccgctcccgtccagatgcccacagccgaaagcacaggcatgacccctgagaaagtgcctgtgtccgaggtcatgggaaccacattctccagctggcagattgtgtgtagcagactggaagagtataactcccaccaaagcctctgcaatggcacacccgaaggccctctgagagaccctatctttgtggtcctgcatagctttaccgatgccattttcgatgagtggatgaaaaggtttaaccctcccgctgacgcttggcctcacatgctggctagggcttgccaacacgctcagggaatcgctaggctccacaaaaggcaaaggcctgtgcatcagggattcggactgaaactgctcaccgtcctgacagtggtcaccggaagcggacacgctagctccacccctggcggagagaaagagacaagcgctacccaaaggtccttctgtagctgtcccattggcgaaaactcccccctcctgtccggccaacaggtcgccgctacctttagctttaggaatgccctcgagggattcgataaggctgacggaaccctcgactcccaggtcatgtccctgcataacctcgtgcatagccatcagtccctgtgtaacggaacccctgagggacccctcaggagaaaccctggcaatcacgataagtccaggacacccagactgcctccctttttccctcccgtcaccaatgaggaactgtttctgacaagcgatcagctcggctatagctatgccattgacctccccgtcagcgtcgagagaaagaaaccccctgtgattaggcaaaacattcactccctgtccccccaagagagagagcaattcctcggcgctctggatctggctcaggaactggctcccattggccataacagaatgtataacatggtgcctttctttccccctgtgacaaacgaagagctcttcctcacctccgaggtcagcattgtggtcctgtccggcacaaccgctgcccaagtgacaaccacagagtgggtggaaaccacagccagagagctccccattacctccccccaactgtccaccggagtgtccttctttttcctcagctttcacattagcaatctgcaattcaatagctccctggaagacccttaccatacccatggcagatacgtcccccctagctccaccgataggtccccctatgagaaagtgtccgccggaaacggaggctccagcctcctgtttctgtccctgggactggtcagcctcgtggaaaacgctctggtcgtggctaccattgccaaaaacagaaacctccactcccccatgagctttctgaatggcacaaacgctctgcctcactccgccgctaacgatcccattttcgtcgtgctccactccttcacagacgctatctttgccgtctgccaatgcagaaggaaaaactatggccaactggatatctttcccgctagggatacctatcaccctatgtccgagtatcccacagtgtttttcctcgccatgctggtcctgatggccgtcctgtatgtgcatatgctcgccagagcctgtcagcatgcccaaggcattgccagaagcacaaactccttcagaaacacagtggaaggctatagcgatcccacaggcaaatacgatcccgctgtgagaagcctccacaatctggctctgccttactggaactttgccacaggcaaaaacgtctgcgatatctgtaccgatgacctcatgggaagcagaagcaatttcgatagcacaatcacagaccaagtgcctttctccgtgtccgtgtcccagctcagggctctggatggcggaaacaaacactttctgagaaaccaacccctcttccatatctccaacctccagtttaactccagcctcgaggatccctccaccgattactatcaggaactgcaaagggatatctccgagatgagcccttacgaaaaggtcagcgctggcaatggcggaagctccctgtcctacacaaaccctgccgtcgccgctgcctccgccaatctggcttacgtcatccctatcggaacctatggccaaatgaaaaacggaagcacacccatgttcaatgacattaacatttacgatctgtttgtgtggaggctctgccaacccgtcctgcctagccctgcctgtcagctcgtgctccaccaaatcctcaagggaggctccggcacatactgtctgaataggtatggctccttctccgtgacactggatatcgtccagggaatcgaaagcgctgagattctgcaagccgtcccctccggcgaaggcgatcaccatgcctttgtggatagcattttcgaacagtggctgcaaaggcataggcctctgcaagaggtctaccctgaggctaacgctcccatttgcacagacgatctgatgggctccaggtccaactttgactccaccctcatctcccccaatagcgtcttctcccagtggagggtcgtgtgtttccctgccagagacacataccatcccatgagcgaataccctacctatcacacacacggaaggtatgtgcctccctccagcacagacagaagctataccaatcccgctgtggctgccgctagcgctaacctcgccgctgagcatcccacatgcggatgcattttcaaaaactttaacctcttcctcgccctcatcatttgcaatgccattatcgatcccctcatctatatgtcccaggtccagggaagcgctaacgatcccattttcctcctgcatcacgctttcgtcgactccatctttgagcaatggctccagagaaggaatagcatgaagctccccacactgaaagacattagggattgcctcagcctccagaaattcgataaccctccctttttccaaaactccctgattagcagagccctcgtggtcacccatacctatctggaacccggacccgtcaccgctcaggtcgtgctccaggctgccattcccctcagctttgccctcccctattggaatttcgctaccggaaggaatgagtgtgacgtctgcacagaccaactgtttggcgctgccagacccgatgtgattggcgctctgctcgccgtcggcgctaccaaagtgcctaggaatcaggattggctcggcgtcagcagacagctcaggacaaaggctgccctcgacggaggcaataagcatttcctcaggaatcagcctctgacattcgctctgcaactgcatgaccctagcggatacctcgccgaatgcgatgtgtgtaccgatcagctcttcggagccgctaggcctgacgatcccacactgattagcagaaactccaggtttagctcctgggaagccgctatgcctagggaagacgctcactttatctatggctatcccaaaaagggacacggacactcctacacaaccgctgaggaagccgctaccggaaagtatgaccctgccgtcaggtccctgcataacctcgcccatctgtttctgaatggcacaggcggacagacacacctcagctccagcgatgtgtccgtgtccgacgtcccctttccctttagcgctcagtccggcgctggcgtccccggatggggaatcgctctgctcgtgctcagccctcaggaaagggaacagtttctgggagccctcgacctcgccaaaaagagagtgcatcccgattacgtcatcacaacccaacactggttctttgcctatctgacactggctaagcataccattagctccgactatgtgattcccattggcacatacggacagatgaagaatggctccggcacaaacgtcctggaaaccgctgtgattctgctcctggaagccggagccctcgtggctagggctgccgtcctgcaacagctcgacaatgtgtgtgtgctcgtggctctggctatcgtctacctcatcgctctggctgtgtgtcagtgtaggagaaagaattacggacagctcgacatttgccctcaggaaggctttgaccatagggatagcaaagtgtccctgcaagagaaaaactgtgagcctgtggtccccaatgcccctcccgctagcgtcctgtccagccatagccctggctccggctccagcacaacccaaggccaagacgtcaccctcgcccctgccacagagcctgcctccgacgaatggatgaagagattcaatccccctgccgatgcctggccccaagagctcgcccctatcggacacaataggatgtacaatatggtcgcctttcactcccaggaactgagaaggacactgaaagaggtcctgacatgctcctgggctgccttctcccaccaaggccctgcctttgtgacatggcataggtatcacctcctgtgtctggaaagggatctgcaaaggctcatcggaaacgaaaggcctatggtccagagactgcctgagcctcaggatgtggctcagtgtctggaagtgggactgtttgacacaccccctttctatagcaatcaggatcccattttcgtcctgctccacacattcacagacgctgtgtttgacgaatggctcaggagatacaatgccgatatctccacctttctgggagccgaaagcgctaacgtctgcggaagccaacagggaaggggacagtgtaccgaagtgagagccgataccagaccctggagcggatacaattgcggagactgtaagtttggctggaccggacccaattgcgaaaggaaaaagcctcccgtcatcagacagaatatccatagcctccacctcttcctcaacggaaccggaggccaaacccatctgtccagccaagaccctatctttgtgctcctgcatacctttaccgatgccgtcggcctcgtgtccctgctctgcagacacaaaaggaaacagctccccgaagagaaacagcctctgctcatggaaaaggaagactatcactccggctgtaagattctgcctggcgctcagggacagtttcccagagtgtgtatgacagtggatagcctcgtgaataaggaatgctgtcccagacagctcccccatagctccagccattggctcaggctccccagaatcttttgctcctgccctatcggagagaatagccctctgctcagcggagacggaggcccttgccctagcggaagctggagccaaaagagaagctttgtgtatgtgtggaagacatggggacagtattggcaagtgctcaaccaagactggctgggagtgtccaggcaactgagaaccaaagcctggaacagacagctctaccctgagtggaccgaagcccaaaggctcatctggagggatatcgatttcgctcacgaagcccctgcctttctgccttggcataggctcttcctcctgagatgggaacaggaaatccaagccgctatgacacccggaacccaaagccctttctttctgctcctgctcctgacagtgctcaccgtcgtgacaggctccggccatgcctccgacaaaagcctccacgtcggcacacagtgtgccctcaccagaaggtgtccccaagagggattcgatcacagagactccaaggtcagcctcaacgtcacctccgcctccggctccgcctccggctccgcctccaccctcgtgcataacggaacctccgccagagccacaaccacacccgctctggaaggctttgcctcccccctcaccggaatcgctgacgctagccaaagctccatgcataacgctctgcatatctatatgaatggcacaagggataccctcctgggacccggaaggccttacagagccattgactttagccatcagggacccgctttcgtcacctggcacagataccatgccgctatgctcctggctgtgctctactgtctgctctggtccttccaaacctccgccggacactttcccagagcctgtgtgtccagcaaagcctttgagctcaccgtcagctgtcagggaggcctccccaaagaggcttgcatggagattagctcccccggatgccaaccccctgcccaagtggatgacagagagtcctggcctagcgtcttctataacagaacctgtcagtgtagcggaaactttatgggattcaattgcggaaactgtgagtccgccgaaatcctccaggctgtgcctagcggagagggagacgctttcgaactgacagtgtcctgccaaggcggactgcctaaggaaaccgtctgcgatagcctcgacgattacaatcacctcgtgacactgtgtaacggaacctatgagggactgctcaggagaaaccaaatgggactgctcagcaatgcccctctgggaccccaattccctttcacaggcgtcgacgatagggaaagctggccctccgtgttttacaataggacatacgaaaagctcagcgctgagcaaagccctcccccttactcccccgctgccatcgtcggcattctgctcgtgctcatggctgtggtcctggctagcctcatctataggagaaggctcatgaaacaggatttctccgtgcctggcattggcattctgacagtgattctgggagtgctcctgctcatcggatgctggtactgtaggagaaggaatggctatagggctctgatgtactcctacctccaggatagcgatcccgatagctttcaggattacattaagtcctacctcgagcaagcctccaggatttggtcctggctccagggacaggatgtgacactggctcccgctaccgaacccgctagcggaagcgctgccacatggggacaggatgtgacaagcgtccccgtcacctcctgcggaagctcccccgtccccggaaccacagacggacacagacccacagccgaagcccctaacacaaccgctggccaagtgcctctggtccacaatggcacaagcgctagggctaccacaacccctgcctccaagtccacccctttctccatccctagccatcactccgacacagaggaaacccctggctggcccacaaccctcctggtcgtgatgggcacactggtcgccctcgtgggactgtttgtgctcctggctttcctcaccacaaccgaatgggtcgagacaaccgctagggaactgcctatccctgagcctgagggacccgatgcctccagcattatgtccaccgaaggcgctgtgacactgacaatcctcctgggaatctttttcctctgctggggccctttctttctgcatctgacactgattgtgctctgccctctgggagccgctatggtcggcgctgtgctcaccgctctgctcgccggactggtcagcctcctgtgtaggcataagagaaagcaactgcctggcgctctggtcgccagagccgctgtgctccagcaactggataacgtcatcgatgtgattacctgtagctccatgctcagctccctgtgtatgacacccgaaaaggtccccgtcagcgaagtgatgggcacaaccctcgccgaaatgtccacccctgaggctaccggaatgacacccgctcagacaagcgctggccatttccctagggcttgcgtcagctccaagaatctgatggagaaagagtgttgccctccctggagcggagacagagccctcaggtatcactccatcgtcaccctccccagagcccctagggctgtggctgccatttgggtcgcctccgtggtcttctccaccctcttcagagagggaaccattaacgtccacgatgtggaaacccaattcaatcagtataagacagaggctgcctccaggtataacctcaccattaacctcatggaaaaggaatgctgtcccccttggtccggcgataggtccccctgtggccaactgtccggcagaggctcctgccaaaacattatcaaaagctatctggaacaggctagcagaatctggagctggctgctcggcgctgccatggtgggagccgtcctgacagccctcctggctcccacaaccctcgcctcccactccaccaaaaccgatgcctccagcacacaccatagctccgtgcctcccctcacctccagcaatcactccagcggagccggagtgcctggctggggcattgccctcctggtcctggtctgcgtcctggtcgccctcgccattgtgtatctgattgccctcttcctcggcgctatcgctgtggataggtatatctccatcttttacgctctgagataccatagcattgtgacactgcctagggctcccagactgattatgcctggccaagaggctggcctcggccaagtgcctctgattgtgggaatcctcctggtcctgatggccgtcgtgctcgcctccaccctcgtggctctggtcggcctcttcgtcctgctcgcctttctgcaatacagaaggctcaggaaaggctatacccctctgatggagacactgattagccctaactccgtgtttagccaatggagagtggtctgcgatagcctcgaggattacgataccctcggcacactgtgtaactccctgaatagcacacccacagccattccccaactgggactggctgccaatcagacaggcgctaggtgtctggaagtgtccatctccgacggacacagacccctccaggaagtgtatcccgaagccaatgcccctatcggacacaatagggaaagctatatggtcccctttatccctctgtatgagcctagcggaaccacaagcgtccaggtccccacaaccgaagtgattagcacagcccctgtgcaaatgcctaccgctgagtccaccggaaagaaaagggtccaccctgactatgtgattaccacacagcattggctcggcctcctgggacccaatggcacacagcctcagtttgccaatctgcatcagattctgaaaggcggaagcggaacctattgcctcaacgtcagcctcgccgataccaatagcctcgccgtcgtgtccacccaacccgaacccgaaggccctgacgctagctccatcatgagcacagagtccatcacaggctccctgggacccctcctggatggcacagccacaagcattaccggaagcctcggccctctgctcgacggaaccgctaccctcaggctcgtgaaaaggcaagtgcctctggattgcgtcctgtatgactgttggagaggcggacaggtcagcctcaaggtcagcaatgacggacccacactgattggcgctaacgctagctttagcattgccctc

SEQ ID NO: 1210 - protein, 5546 aa, Artificial
  Differentiation svaine
WNRQLYPEWTEAQRLDCWRGGQVSLKVSNDPYILRNQDDRELWPRKFFHRTCKCTGNFAGRNGDFFISSKDLGYDYSYLQDSDPDSFQDYAAPAFLTWHRYHLLRLEKDMQEMLQEPSFSGHNRESYMVPFIPLYRNGDFFISSKDLGYDLLCLERDLQRLIGNESFALPYWNFATGRNETTEVVGTTPGQAPTAEPSGTTSVQVPTTEVSTDYYQELQRDISEMFLQIYKQGGFLGLSNACMEISSPGCQPPAQRLCQPVLPSPACQLVDQLGYSYAIDLPVSVEETPGWPTTLLVVMGTEDGPIRRNPAGNVARPMVQRLPEPQDVAQCMTVDSLVNKECCPRLGAESANVCGSQQGRNQYKTEAASRYNLTISDVSVSDVPFPFSAQAAMSPLWWGFLLSCLGCKILPGAQGQFPRVADLSYTWDFGDSSGTLISRALVVTHTYLEPLAEMSTPEATGMTPAEVSIVVLSGTTAAQVIKFRPGSVVVQLTLAFREGTINVHDVETQFGSAATWGQDVTSVPVTRPALGSTTPPAHDVLHKRQRPVHQGFGLKGAVTLTILLGIFFLCLALIICNAIIDPLIYAFHSQELRRTLKEVLKFFHRTCKCTGNFAGYNCGDCKFGWTGPNCLSLQKFDNPPFFQNSTFSFRNALEGFDKADSKSTPFSIPSHHSDTPTTLASHSTKTDASSAANRPALGSTAPPVHNVTSASGSASGSASTCNGTYEGLLRRNQMGRNSMKLPTLKDIRDCTHHSSVPPLTSSNHSTSPQLSTGVSFFFLSFIAYYDHVAVLLCLVVFFLAMLVLMAVLYVKLTGDENFTIPYWDWRDAEKCDICTDEYMGLRLVKRQVPLDCVLYRYGSFSVTLDIVQGIFLQIYKQGGFLGLSNIKFRPGSVVVQLTLAVIDVITCSSMLSSLCFLGAIAVDRYISIFYRNPGNHDKSRTPRLPSSADVEFCLSLTQYEFDEWLRRYNADISTFPLENAPIGHNRQYNMVSLADTNSLAVVSTQLIMPGQEAGLGQVPLGPVTAQVVLQAAIPLTSCGSSPVPGTTDGHKFGFWGPNCTERRLLVRRNIFDLSAPEKDKLGTHTMEVTVYHRRGSRSYVPLAHSSSAFTAVAAIWVASVVFSTLFIAYYDHVAVLLCLVGTLDSQVMSLHNLVHSFLNGTNALPHSAANGCWYCRRRNGYRALMDKSLHVGTQCALTRRPWHRLFLLRWEQEIQKLTGDENFTIPYWDWAAMAVQGSQRRLLGSLNSTPTAIPQLGLAAVVATIAKNRNLHSPMYCFICCLALSDLLVSQSSMHNALHIYMNGTMSQVQGSANDPIFLLGQHPTNPNLLSPASFFSSWQIVCSRLEEYNYCFICCLALSDLLVSGTNVLETAVILLLEADPTLISRNSRFSSWETVCDSLDDYNHLVTLTRPALGSTTPPAHDVTSAPDNKAARDAEKCDICTDEYMGGQHPTNPNLLSPASFTFALQLHDPSGYLAEADLSYTWDFGDSSGTSSADVEFCLSLTQYESGSMDKAANFSFRNTGPTLIGANASFSIALNFPGSQKVLPDGQVIWGPFFLHLTLIVLCPEHPTCGCIFKNFNLFCQCSGNFMGFNCGNCKFGFWGPNCTERRLLQYRRLRKGYTPLMETHLSSKRYTEEAAAPLENAPIGHNRQYNMVPFWPPVTNTEMFVTNFPGSQKVLPDGQVIWVNNTIINGSQVWGGRPTAEAPNTTAGQVPTTEVVGTTPGQAPTASTPGGEKETSATQRSSVPSSTEKNAVSMTSLIYRRRLMKQDFSVPQLPHSSSHWLRLPRILGLLGPNGTQPQFANCSVYDFFVWLHYYSVCLEVGLFDTPPFYSNSTNSFRNTVEGYSDPAAMDLVLKRCLLHLAVIGALLAVGATKVPRNQTGARCLEVSISDGLFLSLGLVSLVENALSGSMDKAANFSFRNTLEGFASPLTGIADASSPCGQLSGRGSCQNILLSNAPLGPQFPFTGMHYYVSMDALLGGSEIWRDIDFAHEAPAFLEEKQPLLMEKEDYHSLYQSHLAAGQCTEVRADTRPWSGPYILRNQDDRELWPRSVPSSTEKNAVSMTSSVLSSHSPGSGSSTTTPMFNDINIYDLFVWMHYYVSMDALLGGSEQPVYPQETDDACIFPDGGPCPSGSWSQKRSDSLEDYDTLGTLCNSTEDGPIRRNPAGNVAWVNNTIINGSQVWGGQPVYPQETDDACIFPQEKNCEPVVPNAPPAYEKLSAEQSPPPYSPSRSYVPLAHSSSAFTITDQVPFSVSVSQLRLEKDMQEMLQEPSFSLPYWNFATGKNVCDIVPFWPPVTNTEMFVTAPDNLGYTYEAACSVYDFFVWLHYYSVRDTLLGPGRPYRAIDVRRNIFDLSAPEKDKFFAYLTLAKHTISSDKKGHGHSYTTAEEAAGIGILTVILGVLLLIFVYVWKTWGQYWQVLGGPVSGLSIGTGRAMGGPVSGLSIGTGRAMLGTHTMEVTVYHRRGISTAPVQMPTAESTGMTPEKVPVSEVMGTTFSSWQIVCSRLEEYNSHQSLCNGTPEGPLRDPIFVVLHSFTDAIFDEWMKRFNPPADAWPHMLARACQHAQGIARLHKRQRPVHQGFGLKLLTVLTVVTGSGHASSTPGGEKETSATQRSFCSCPIGENSPLLSGQQVAATFSFRNALEGFDKADGTLDSQVMSLHNLVHSHQSLCNGTPEGPLRRNPGNHDKSRTPRLPPFFPPVTNEELFLTSDQLGYSYAIDLPVSVERKKPPVIRQNIHSLSPQEREQFLGALDLAQELAPIGHNRMYNMVPFFPPVTNEELFLTSEVSIVVLSGTTAAQVTTTEWVETTARELPITSPQLSTGVSFFFLSFHISNLQFNSSLEDPYHTHGRYVPPSSTDRSPYEKVSAGNGGSSLLFLSLGLVSLVENALVVATIAKNRNLHSPMSFLNGTNALPHSAANDPIFVVLHSFTDAIFAVCQCRRKNYGQLDIFPARDTYHPMSEYPTVFFLAMLVLMAVLYVHMLARACQHAQGIARSTNSFRNTVEGYSDPTGKYDPAVRSLHNLALPYWNFATGKNVCDICTDDLMGSRSNFDSTITDQVPFSVSVSQLRALDGGNKHFLRNQPLFHISNLQFNSSLEDPSTDYYQELQRDISEMSPYEKVSAGNGGSSLSYTNPAVAAASANLAYVIPIGTYGQMKNGSTPMFNDINIYDLFVWRLCQPVLPSPACQLVLHQILKGGSGTYCLNRYGSFSVTLDIVQGIESAEILQAVPSGEGDHHAFVDSIFEQWLQRHRPLQEVYPEANAPICTDDLMGSRSNFDSTLISPNSVFSQWRVVCFPARDTYHPMSEYPTYHTHGRYVPPSSTDRSYTNPAVAAASANLAAEHPTCGCIFKNFNLFLALIICNAIIDPLIYMSQVQGSANDPIFLLHHAFVDSIFEQWLQRRNSMKLPTLKDIRDCLSLQKFDNPPFFQNSLISRALVVTHTYLEPGPVTAQVVLQAAIPLSFALPYWNFATGRNECDVCTDQLFGAARPDVIGALLAVGATKVPRNQDWLGVSRQLRTKAALDGGNKHFLRNQPLTFALQLHDPSGYLAECDVCTDQLFGAARPDDPTLISRNSRFSSWEAAMPREDAHFIYGYPKKGHGHSYTTAEEAATGKYDPAVRSLHNLAHLFLNGTGGQTHLSSSDVSVSDVPFPFSAQSGAGVPGWGIALLVLSPQEREQFLGALDLAKKRVHPDYVITTQHWFFAYLTLAKHTISSDYVIPIGTYGQMKNGSGTNVLETAVILLLEAGALVARAAVLQQLDNVCVLVALAIVYLIALAVCQCRRKNYGQLDICPQEGFDHRDSKVSLQEKNCEPVVPNAPPASVLSSHSPGSGSSTTQGQDVTLAPATEPASDEWMKRFNPPADAWPQELAPIGHNRMYNMVAFHSQELRRTLKEVLTCSWAAFSHQGPAFVTWHRYHLLCLERDLQRLIGNERPMVQRLPEPQDVAQCLEVGLFDTPPFYSNQDPIFVLLHTFTDAVFDEWLRRYNADISTFLGAESANVCGSQQGRGQCTEVRADTRPWSGYNCGDCKFGWTGPNCERKKPPVIRQNIHSLHLFLNGTGGQTHLSSQDPIFVLLHTFTDAVGLVSLLCRHKRKQLPEEKQPLLMEKEDYHSGCKILPGAQGQFPRVCMTVDSLVNKECCPRQLPHSSSHWLRLPRIFCSCPIGENSPLLSGDGGPCPSGSWSQKRSFVYVWKTWGQYWQVLNQDWLGVSRQLRTKAWNRQLYPEWTEAQRLIWRDIDFAHEAPAFLPWHRLFLLRWEQEIQAAMTPGTQSPFFLLLLLTVLTVVTGSGHASDKSLHVGTQCALTRRCPQEGFDHRDSKVSLNVTSASGSASGSASTLVHNGTSARATTTPALEGFASPLTGIADASQSSMHNALHIYMNGTRDTLLGPGRPYRAIDFSHQGPAFVTWHRYHAAMLLAVLYCLLWSFQTSAGHFPRACVSSKAFELTVSCQGGLPKEACMEISSPGCQPPAQVDDRESWPSVFYNRTCQCSGNFMGFNCGNCESAEILQAVPSGEGDAFELTVSCQGGLPKETVCDSLDDYNHLVTLCNGTYEGLLRRNQMGLLSNAPLGPQFPFTGVDDRESWPSVFYNRTYEKLSAEQSPPPYSPAAIVGILLVLMAVVLASLIYRRRLMKQDFSVPGIGILTVILGVLLLIGCWYCRRRNGYRALMYSYLQDSDPDSFQDYIKSYLEQASRIWSWLQGQDVTLAPATEPASGSAATWGQDVTSVPVTSCGSSPVPGTTDGHRPTAEAPNTTAGQVPLVHNGTSARATTTPASKSTPFSIPSHHSDTEETPGWPTTLLVVMGTLVALVGLFVLLAFLTTTEWVETTARELPIPEPEGPDASSIMSTEGAVTLTILLGIFFLCWGPFFLHLTLIVLCPLGAAMVGAVLTALLAGLVSLLCRHKRKQLPGALVARAAVLQQLDNVIDVITCSSMLSSLCMTPEKVPVSEVMGTTLAEMSTPEATGMTPAQTSAGHFPRACVSSKNLMEKECCPPWSGDRALRYHSIVTLPRAPRAVAAIWVASVVFSTLFREGTINVHDVETQFNQYKTEAASRYNLTINLMEKECCPPWSGDRSPCGQLSGRGSCQNIIKSYLEQASRIWSWLLGAAMVGAVLTALLAPTTLASHSTKTDASSTHHSSVPPLTSSNHSSGAGVPGWGIALLVLVCVLVALAIVYLIALFLGAIAVDRYISIFYALRYHSIVTLPRAPRLIMPGQEAGLGQVPLIVGILLVLMAVVLASTLVALVGLFVLLAFLQYRRLRKGYTPLMETLISPNSVFSQWRVVCDSLEDYDTLGTLCNSLNSTPTAIPQLGLAANQTGARCLEVSISDGHRPLQEVYPEANAPIGHNRESYMVPFIPLYEPSGTTSVQVPTTEVISTAPVQMPTAESTGKKRVHPDYVITTQHWLGLLGPNGTQPQFANLHQILKGGSGTYCLNVSLADTNSLAVVSTQPEPEGPDASSIMSTESITGSLGPLLDGTATSITGSLGPLLDGTATLRLVKRQVPLDCVLYDCWRGGQVSLKVSNDGPTLIGANASFSIAL

SEQ ID NO: 1211 - DNA, 90 bp, Artificial
  BAGE segment 1
  CDS (1)..(90)
gccgctatggctgccagagccgtcttcctcgccctcagcgctcagctcctgcaagccagactgatgaaggaagagtcccccgtcgtgtcc

SEQ ID NO: 1212 - protein, 30 aa, Artificial
  BAGE segment 1
AAMAARAVFLALSAQLLQARLMKEESPVVS

SEQ ID NO: 1213 - DNA, 90 bp, Artificial
  BAGE segment 2
  CDS (1)..(90)
ctgctccaggctaggctcatgaaagaggaaagccctgtggtcagctggaggctcgagcctgaggatggcacagccctctgctttatcttt

SEQ ID NO: 1214 - protein, 30 aa, Artificial
  BAGE segment 2
LLQARLMKEESPVVSWRLEPEDGTALCFIF

SEQ ID NO: 1215 - DNA, 51 bp, Artificial
  BAGE segment 3
  CDS (1)..(51)
tggagactggaacccgaagacggaaccgctctgtgtttcattttcgctgcc

SEQ ID NO: 1216 - protein, 17 aa, Artificial
  BAGE segment 3
WRLEPEDGTALCFIFAA

SEQ ID NO: 1217 - DNA, 90 bp, Artificial
  GAGE-1 segment 1
  CDS (1)..(90)
gccgctatgtcctggagaggcagaagcacatacagacccagacccagaaggtatgtggaaccccctgagatgatcggacccatgaggcct

SEQ ID NO: 1218 - protein, 30 aa, Artificial
  GAGE-1 segment 1
AAMSWRGRSTYRPRPRRYVEPPEMIGPMRP

SEQ ID NO: 1219 - DNA, 90 bp, Artificial
  GAGE-1 segment 2
  CDS (1)..(90)
aggagatacgtcgagcctcccgaaatgattggccctatgagacccgaacagtttagcgatgaggtcgagcctgccacacccgaagaggga

SEQ ID NO: 1220 - protein, 30 aa, Artificial
  GAGE-1 segment 2
RRYVEPPEMIGPMRPEQFSDEVEPATPEEG

SEQ ID NO: 1221 - DNA, 90 bp, Artificial
  GAGE-1 segment 3
  CDS (1)..(90)
gagcaattctccgacgaagtggaacccgctacccctgaggaaggcgaacccgctacccaaaggcaagaccctgccgctgcccaagaggga

SEQ ID NO: 1222 - protein, 30 aa, Artificial
  GAGE-1 segment 3
EQFSDEVEPATPEEGEPATQRQDPAAAQEG

SEQ ID NO: 1223 - DNA, 90 bp, Artificial
  GAGE-1 segment 4
  CDS (1)..(90)
gagcctgccacacagagacaggatcccgctgccgctcaggaaggcgaagacgaaggcgctagcgctggccaaggccctaagcctgaggct

SEQ ID NO: 1224 - protein, 30 aa, Artificial
  GAGE-1 segment 4
EPATQRQDPAAAQEGEDEGASAGQGPKPEA

SEQ ID NO: 1225 - DNA, 90 bp, Artificial
  GAGE-1 segment 5
  CDS (1)..(90)
gaggatgagggagcctccgccggacagggacccaaacccgaagccgatagccaagagcaaggccatccccaaaccggatgcgaatgcgaa

SEQ ID NO: 1226 - protein, 30 aa, Artificial
  GAGE-1 segment 5
EDEGASAGQGPKPEADSQEQGHPQTGCECE

SEQ ID NO: 1227 - DNA, 90 bp, Artificial
  GAGE-1 segment 6
  CDS (1)..(90)
gactcccaggaacagggacaccctcagacaggctgtgagtgtgaggatggccctgacggacaggaaatggatccccctaaccctgaggaa

SEQ ID NO: 1228 - protein, 30 aa, Artificial
  GAGE-1 segment 6
DSQEQGHPQTGCECEDGPDGQEMDPPNPEE

SEQ ID NO: 1229 - DNA, 90 bp, Artificial
  GAGE-1 segment 7
  CDS (1)..(90)
gacggacccgatggccaagagatggaccctcccaatcccgaagaggtcaagacacccgaagaggaaatgagaagccattacgtcgcccaa

SEQ ID NO: 1230 - protein, 30 aa, Artificial
  GAGE-1 segment 7
DGPDGQEMDPPNPEEVKTPEEEMRSHYVAQ

SEQ ID NO: 1231 - DNA, 90 bp, Artificial
  GAGE-1 segment 8
  CDS (1)..(90)
gtgaaaacccctgaggaagagatgaggtcccactatgtggctcagacaggcattctgtggctgctcatgaataactgtttcctcaacctc

SEQ ID NO: 1232 - protein, 30 aa, Artificial
  GAGE-1 segment 8
VKTPEEEMRSHYVAQTGILWLLMNNCFLNL

SEQ ID NO: 1233 - DNA, 66 bp, Artificial
  GAGE-1 segment 9
  CDS (1)..(66)
accggaatcctctggctcctgatgaacaattgctttctgaatctgtcccccagaaagcctgccgct

SEQ ID NO: 1234 - protein, 22 aa, Artificial
  GAGE-1 segment 9
TGILWLLMNNCFLNLSPRKPAA

SEQ ID NO: 1235 - DNA, 90 bp, Artificial
  gp100ln4 segment 1
  CDS (1)..(90)
gccgctagctggagccaaaagagaagctttgtgtatgtgtggaagacatggggagagggactgcctagccaacccattatccatacctgt

SEQ ID NO: 1236 - protein, 30 aa, Artificial
  gp100ln4 segment 1
AASWSQKRSFVYVWKTWGEGLPSQPIIHTC

SEQ ID NO: 1237 - DNA, 90 bp, Artificial
  gp100ln4 segment 2
  CDS (1)..(90)
acctggggcgaaggcctcccctcccagcctatcattcacacatgcgtctactttttcctccccgatcacctcagctttggcagacccttt

SEQ ID NO: 1238 - protein, 30 aa, Artificial
  gp100ln4 segment 2
TWGEGLPSQPIIHTCVYFFLPDHLSFGRPF

SEQ ID NO: 1239 - DNA, 75 bp, Artificial
  gp100ln4 segment 3
  CDS (1)..(75)
gtgtatttctttctgcctgaccatctgtccttcggaaggcctttccatctgaatttctgtgactttctggctgcc

SEQ ID NO: 1240 - protein, 25 aa, Artificial
  gp100ln4 segment 3
VYFFLPDHLSFGRPFHLNFCDFLAA

SEQ ID NO: 1241 - DNA, 90 bp, Artificial
  MAGE-1 segment 1
  CDS (1)..(90)
gccgctatgtccctggaacagagaagcctccactgtaagcctgaggaagccctcgaggctcagcaagaggctctgggactggtctgcgtc

SEQ ID NO: 1242 - protein, 30 aa, Artificial
  MAGE-1 segment 1
AAMSLEQRSLHCKPEEALEAQQEALGLVCV

SEQ ID NO: 1243 - DNA, 90 bp, Artificial
  MAGE-1 segment 2
  CDS (1)..(90)
gaggctctggaagcccaacaggaagccctcggcctcgtgtgtgtgcaagccgctacctccagctccagccctctggtcctgggaaccctc

SEQ ID NO: 1244 - protein, 30 aa, Artificial
  MAGE-1 segment 2
EALEAQQEALGLVCVQAATSSSSPLVLGTL

SEQ ID NO: 1245 - DNA, 90 bp, Artificial
  MAGE-1 segment 3
  CDS (1)..(90)
caggctgccacaagctccagctcccccctcgtgctcggcacactggaagaggtccccacagccggaagcacagaccctccccaaagccct

SEQ ID NO: 1246 - protein, 30 aa, Artificial
  MAGE-1 segment 3
QAATSSSSPLVLGTLEEVPTAGSTDPPQSP

SEQ ID NO: 1247 - DNA, 90 bp, Artificial
  MAGE-1 segment 4
  CDS (1)..(90)
gaggaagtgcctaccgctggctccaccgatccccctcagtccccccaaggcgctagcgctttccctaccacaatcaatttcacaaggcaa

SEQ ID NO: 1248 - protein, 30 aa, Artificial
  MAGE-1 segment 4
EEVPTAGSTDPPQSPQGASAFPTTINFTRQ

SEQ ID NO: 1249 - DNA, 90 bp, Artificial
  MAGE-1 segment 5
  CDS (1)..(90)
cagggagcctccgcctttcccacaaccattaactttaccagacagagacagcctagcgaaggctccagctccagggaagaggaaggccct

SEQ ID NO: 1250 - protein, 30 aa, Artificial
  MAGE-1 segment 5
QGASAFPTTINFTRQRQPSEGSSSREEEGP

SEQ ID NO: 1251 - DNA, 90 bp, Artificial
  MAGE-1 segment 6
  CDS (1)..(90)
aggcaaccctccgagggaagctccagcagagaggaagagggaccctccacctcctgcattctggaaagcctcttcagagccgtcatcaca

SEQ ID NO: 1252 - protein, 30 aa, Artificial
  MAGE-1 segment 6
RQPSEGSSSREEEGPSTSCILESLFRAVIT

SEQ ID NO: 1253 - DNA, 90 bp, Artificial
  MAGE-1 segment 7
  CDS (1)..(90)
agcacaagctgtatcctcgagtccctgtttagggctgtgattaccaaaaaggtcgccgatctggtcggctttctgctcctgaaatacaga

SEQ ID NO: 1254 - protein, 30 aa, Artificial
  MAGE-1 segment 7
STSCILESLFRAVITKKVADLVGFLLLKYR

SEQ ID NO: 1255 - DNA, 90 bp, Artificial
  MAGE-1 segment 8
  CDS (1)..(90)
aagaaagtggctgacctcgtgggattcctcctgctcaagtatagggctagggaacccgtcaccaaagccgaaatgctcgagtccgtgatt

SEQ ID NO: 1256 - protein, 30 aa, Artificial
  MAGE-1 segment 8
KKVADLVGFLLLKYRAREPVTKAEMLESVI

SEQ ID NO: 1257 - DNA, 90 bp, Artificial
  MAGE-1 segment 9
  CDS (1)..(90)
gccagagagcctgtgacaaaggctgagatgctggaaagcgtcatcaaaaactataagcattgctttcccgaaatctttggcaaagcctcc

SEQ ID NO: 1258 - protein, 30 aa, Artificial
  MAGE-1 segment 9
AREPVTKAEMLESVIKNYKHCFPEIFGKAS

SEQ ID NO: 1259 - DNA, 90 bp, Artificial
  MAGE-1 segment 10
  CDS (1)..(90)
aagaattacaaacactgtttccctgagattttcggaaaggctagcgaaagcctccagctcgtgtttggcattgacgtcaaggaagccgat

SEQ ID NO: 1260 - protein, 30 aa, Artificial
  MAGE-1 segment 10
KNYKHCFPEIFGKASESLQLVFGIDVKEAD

SEQ ID NO: 1261 - DNA, 90 bp, Artificial
  MAGE-1 segment 11
  CDS (1)..(90)
gagtccctgcaactggtcttcggaatcgatgtgaaagaggctgaccctaccggacactcctacgtcctggtcacctgtctgggactgtcc

SEQ ID NO: 1262 - protein, 30 aa, Artificial
  MAGE-1 segment 11
ESLQLVFGIDVKEADPTGHSYVLVTCLGLS

SEQ ID NO: 1263 - DNA, 90 bp, Artificial
  MAGE-1 segment 12
  CDS (1)..(90)
cccacaggccatagctatgtgctcgtgacatgcctcggcctcagctatgacggactgctcggcgataaccaaatcatgcccaaaaccgga

SEQ ID NO: 1264 - protein, 30 aa, Artificial
  MAGE-1 segment 12
PTGHSYVLVTCLGLSYDGLLGDNQIMPKTG

SEQ ID NO: 1265 - DNA, 90 bp, Artificial
  MAGE-1 segment 13
  CDS (1)..(90)
tacgatggcctcctgggagacaatcagattatgcctaagacaggctttctgattatcgtcctggtcatgattgccatggagggaggccat

SEQ ID NO: 1266 - protein, 30 aa, Artificial
  MAGE-1 segment 13
YDGLLGDNQIMPKTGFLIIVLVMIAMEGGH

SEQ ID NO: 1267 - DNA, 90 bp, Artificial
  MAGE-1 segment 14
  CDS (1)..(90)
ttcctcatcattgtgctcgtgatgatcgctatggaaggcggacacgctcccgaagaggaaatctgggaggaactgtccgtgatggaggtc

SEQ ID NO: 1268 - protein, 30 aa, Artificial
  MAGE-1 segment 14
FLIIVLVMIAMEGGHAPEEEIWEELSVMEV

SEQ ID NO: 1269 - DNA, 90 bp, Artificial
  MAGE-1 segment 15
  CDS (1)..(90)
gcccctgaggaagagatttgggaagagctcagcgtcatggaagtgtatgacggaagggaacactccgcctatggcgaacccagaaagctc

SEQ ID NO: 1270 - protein, 30 aa, Artificial
  MAGE-1 segment 15
APEEEIWEELSVMEVYDGREHSAYGEPRKL

SEQ ID NO: 1271 - DNA, 90 bp, Artificial
  MAGE-1 segment 16
  CDS (1)..(90)
tacgatggcagagagcatagcgcttacggagagcctaggaaactgctcacccaagacctcgtgcaagagaaatacctcgagtataggcaa

SEQ ID NO: 1272 - protein, 30 aa, Artificial
  MAGE-1 segment 16
YDGREHSAYGEPRKLLTQDLVQEKYLEYRQ

SEQ ID NO: 1273 - DNA, 90 bp, Artificial
  MAGE-1 segment 17
  CDS (1)..(90)
ctgacacaggatctggtccaggaaaagtatctggaatacagacaggtccccgatagcgatcccgctaggtatgagtttctgtggggccct

SEQ ID NO: 1274 - protein, 30 aa, Artificial
  MAGE-1 segment 17
LTQDLVQEKYLEYRQVPDSDPARYEFLWGP

SEQ ID NO: 1275 - DNA, 90 bp, Artificial
  MAGE-1 segment 18
  CDS (1)..(90)
gtgcctgactccgaccctgccagatacgaattcctctggggacccagagccctcgccgaaacctcctacgtcaaggtcctggaatacgtc

SEQ ID NO: 1276 - protein, 30 aa, Artificial
  MAGE-1 segment 18
VPDSDPARYEFLWGPRALAETSYVKVLEYV

SEQ ID NO: 1277 - DNA, 90 bp, Artificial
  MAGE-1 segment 19
  CDS (1)..(90)
agggctctggctgagacaagctatgtgaaagtgctcgagtatgtgattaaggtcagcgctagggtcaggtttttctttccctccctgaga

SEQ ID NO: 1278 - protein, 30 aa, Artificial
  MAGE-1 segment 19
RALAETSYVKVLEYVIKVSARVRFFFPSLR

SEQ ID NO: 1279 - DNA, 84 bp, Artificial
  MAGE-1 segment 20
  CDS (1)..(84)
atcaaagtgtccgccagagtgagattctttttccctagcctcagggaagccgctctgagagaggaagaggaaggcgtcgccgct

SEQ ID NO: 1280 - protein, 28 aa, Artificial
  MAGE-1 segment 20
IKVSARVRFFFPSLREAALREEEEGVAA

SEQ ID NO: 1281 - DNA, 90 bp, Artificial
  MAGE-3 segment 1
  CDS (1)..(90)
gccgctatgcctctggaacagagaagccaacactgtaagcctgaggaaggcctcgaggctaggggagaggctctgggactggtcggcgct

SEQ ID NO: 1282 - protein, 30 aa, Artificial
  MAGE-3 segment 1
AAMPLEQRSQHCKPEEGLEARGEALGLVGA

SEQ ID NO: 1283 - DNA, 90 bp, Artificial
  MAGE-3 segment 2
  CDS (1)..(90)
gagggactggaagccagaggcgaagccctcggcctcgtgggagcccaagcccctgccacagaggaacaggaagccgctagctccagctcc

SEQ ID NO: 1284 - protein, 30 aa, Artificial
  MAGE-3 segment 2
EGLEARGEALGLVGAQAPATEEQEAASSSS

SEQ ID NO: 1285 - DNA, 90 bp, Artificial
  MAGE-3 segment 4
  CDS (1)..(90)
caggctcccgctaccgaagagcaagaggctgcctccagctccagcacactggtcgaggtcaccctcggcgaagtgcctgccgctgagtcc

SEQ ID NO: 1286 - protein, 30 aa, Artificial
  MAGE-3 segment 4
QAPATEEQEAASSSSTLVEVTLGEVPAAES

SEQ ID NO: 1287 - DNA, 90 bp, Artificial
  MAGE-3 segment 5
  CDS (1)..(90)
accctcgtggaagtgacactgggagaggtccccgctgccgaaagccctgaccctccccaaagccctcagggagcctccagcctccccaca

SEQ ID NO: 1288 - protein, 30 aa, Artificial
  MAGE-3 segment 5
TLVEVTLGEVPAAESPDPPQSPQGASSLPT

SEQ ID NO: 1289 - DNA, 90 bp, Artificial
  MAGE-3 segment 6
  CDS (1)..(90)
cccgatccccctcagtccccccaaggcgctagctccctgcctaccacaatgaattaccctctgtggagccaaagctatgaggatagctcc

SEQ ID NO: 1290 - protein, 30 aa, Artificial
  MAGE-3 segment 6
PDPPQSPQGASSLPTTMNYPLWSQSYEDSS

SEQ ID NO: 1291 - DNA, 90 bp, Artificial
  MAGE-3 segment 6
  CDS (1)..(90)
accatgaactatcccctctggtcccagtcctacgaagactccagcaatcaggaagaggaaggccctagcacattccctgacctcgagtcc

SEQ ID NO: 1292 - protein, 30 aa, Artificial
  MAGE-3 segment 6
TMNYPLWSQSYEDSSNQEEEGPSTFPDLES

SEQ ID NO: 1293 - DNA, 90 bp, Artificial
  MAGE-3 segment 7
  CDS (1)..(90)
aaccaagaggaagagggaccctccacctttcccgatctggaaagcgaattccaagccgctctgtccaggaaagtggctgagctcgtgcat

SEQ ID NO: 1294 - protein, 30 aa, Artificial
  MAGE-3 segment 7
NQEEEGPSTFPDLESEFQAALSRKVAELVH

SEQ ID NO: 1295 - DNA, 90 bp, Artificial
  MAGE-3 segment 8
  CDS (1)..(90)
gagtttcaggctgccctcagcagaaaggtcgccgaactggtccactttctgctcctgaaatacagagccagagagcctgtgacaaaggct

SEQ ID NO: 1296 - protein, 30 aa, Artificial
  MAGE-3 segment 8
EFQAALSRKVAELVHFLLLKYRAREPVTKA

SEQ ID NO: 1297 - DNA, 90 bp, Artificial
  MAGE-3 segment 9
  CDS (1)..(90)
ttcctcctgctcaagtatagggctagggaacccgtcaccaaagccgaaatgctcggctccgtggtcggcaattggcaatactttttccct

SEQ ID NO: 1298 - protein, 30 aa, Artificial
  MAGE-3 segment 9
FLLLKYRAREPVTKAEMLGSVVGNWQYFFP

SEQ ID NO: 1299 - DNA, 90 bp, Artificial
  MAGE-3 segment 10
  CDS (1)..(90)
gagatgctgggaagcgtcgtgggaaactggcagtatttctttcccgtcatctttagcaaagcctccagctccctgcaactggtcttcgga

SEQ ID NO: 1300 - protein, 30 aa, Artificial
  MAGE-3 segment 10
EMLGSVVGNWQYFFPVIFSKASSSLQLVFG

SEQ ID NO: 1301 - DNA, 90 bp, Artificial
  MAGE-3 segment 11
  CDS (1)..(90)
gtgattttctccaaggctagctccagcctccagctcgtgtttggcattgagctcatggaagtggatcccattggccatctgtatatcttt

SEQ ID NO: 1302 - protein, 30 aa, Artificial
  MAGE-3 segment 11
VIFSKASSSLQLVFGIELMEVDPIGHLYIF

SEQ ID NO: 1303 - DNA, 90 bp, Artificial
  MAGE-3 segment 12
  CDS (1)..(90)
atcgaactgatggaggtcgaccctatcggacacctctacattttcgctacctgtctgggactgtcctacgatggcctcctgggagacaat

SEQ ID NO: 1304 - protein, 30 aa, Artificial
  MAGE-3 segment 12
IELMEVDPIGHLYIFATCLGLSYDGLLGDN

SEQ ID NO: 1305 - DNA, 90 bp, Artificial
  MAGE-3 segment 13
  CDS (1)..(90)
gccacatgcctcggcctcagctatgacggactgctcggcgataaccaaatcatgcccaaagccggactgctcatcattgtgctcgccatt

SEQ ID NO: 1306 - protein, 30 aa, Artificial
  MAGE-3 segment 13
ATCLGLSYDGLLGDNQIMPKAGLLIIVLAI

SEQ ID NO: 1307 - DNA, 90 bp, Artificial
  MAGE-3 segment 14
  CDS (1)..(90)
cagattatgcctaaggctggcctcctgattatcgtcctggctatcattgccagagagggagactgtgcccctgaggaaaagatttgggaa

SEQ ID NO: 1308 - protein, 30 aa, Artificial
  MAGE-3 segment 14
QIMPKAGLLIIVLAIIAREGDCAPEEKIWE

SEQ ID NO: 1309 - DNA, 90 bp, Artificial
  MAGE-3 segment 15
  CDS (1)..(90)
atcgctagggaaggcgattgcgctcccgaagagaaaatctgggaggaactgtccgtgctcgaggtcttcgaaggcagagaggatagcatt

SEQ ID NO: 1310 - protein, 30 aa, Artificial
  MAGE-3 segment 15
IAREGDCAPEEKIWEELSVLEVFEGREDSI

SEQ ID NO: 1311 - DNA, 90 bp, Artificial
  MAGE-3 segment 16
  CDS (1)..(90)
gagctcagcgtcctggaagtgtttgagggaagggaagactccatcctcggcgatcccaaaaagctcctgacacagcatttcgtccaggaa

SEQ ID NO: 1312 - protein, 30 aa, Artificial
  MAGE-3 segment 16
ELSVLEVFEGREDSILGDPKKLLTQHFVQE

SEQ ID NO: 1313 - DNA, 90 bp, Artificial
  MAGE-3 segment 17
  CDS (1)..(90)
ctgggagaccctaagaaactgctcacccaacactttgtgcaagagaattacctcgagtataggcaagtgcctggctccgaccctgcctgt

SEQ ID NO: 1314 - protein, 30 aa, Artificial
  MAGE-3 segment 17
LGDPKKLLTQHFVQENYLEYRQVPGSDPAC

SEQ ID NO: 1315 - DNA, 90 bp, Artificial
  MAGE-3 segment 18
  CDS (1)..(90)
aactatctggaatacagacaggtccccggaagcgatcccgcttgctatgagtttctgtggggccctagggctctggtcgagacaagctat

SEQ ID NO: 1316 - protein, 30 aa, Artificial
  MAGE-3 segment 18
NYLEYRQVPGSDPACYEFLWGPRALVETSY

SEQ ID NO: 1317 - DNA, 90 bp, Artificial
  MAGE-3 segment 19
  CDS (1)..(90)
tacgaattcctctggggacccagagccctcgtggaaacctcctacgtcaaggtcctgcatcacatggtgaaaatctccggcggaccccat

SEQ ID NO: 1318 - protein, 30 aa, Artificial
  MAGE-3 segment 19
YEFLWGPRALVETSYVKVLHHMVKISGGPH

SEQ ID NO: 1319 - DNA, 90 bp, Artificial
  MAGE-3 segment 20
  CDS (1)..(90)
gtgaaagtgctccaccatatggtcaagattagcggaggccctcacattagctatccccctctgcatgagtgggtgctcagggaaggcgaa

SEQ ID NO: 1320 - protein, 30 aa, Artificial
  MAGE-3 segment 20
VKVLHHMVKISGGPHISYPPLHEWVLREGE

SEQ ID NO: 1321 - DNA, 54 bp, Artificial
  MAGE-3 segment 21
  CDS (1)..(54)
atctcctaccctcccctccacgaatgggtcctgagagagggagaggaagccgct

SEQ ID NO: 1322 - protein, 18 aa, Artificial
  MAGE-3 segment 21
ISYPPLHEWVLREGEEAA

SEQ ID NO: 1323 - DNA, 90 bp, Artificial
  PRAME segment 1
  CDS (1)..(90)
gccgctatggaaaggagaaggctctggggaagcattcagtccaggtatatctccatgtccgtgtggacctcccccagaaggctcgtggaa

SEQ ID NO: 1324 - protein, 30 aa, Artificial
  PRAME segment 1
AAMERRRLWGSIQSRYISMSVWTSPRRLVE

SEQ ID NO: 1325 - DNA, 90 bp, Artificial
  PRAME segment 2
  CDS (1)..(90)
tacattagcatgagcgtctggacaagccctaggagactggtcgagctcgccggacagtccctgctcaaggatgaggctctggctatcgct

SEQ ID NO: 1326 - protein, 30 aa, Artificial
  PRAME segment 2
YISMSVWTSPRRLVELAGQSLLKDEALAIA

SEQ ID NO: 1327 - DNA, 90 bp, Artificial
  PRAME segment 3
  CDS (1)..(90)
ctggctggccaaagcctcctgaaagacgaagccctcgccattgccgctctggaactgctccccagagagctcttccctcccctcttcatg

SEQ ID NO: 1328 - protein, 30 aa, Artificial
  PRAME segment 3
LAGQSLLKDEALAIAALELLPRELFPPLFM

SEQ ID NO: 1329 - DNA, 90 bp, Artificial
  PRAME segment 4
  CDS (1)..(90)
gccctcgagctcctgcctagggaactgtttccccctctgtttatggctgcctttgacggaaggcatagccaaaccctcaaggctatggtc

SEQ ID NO: 1330 - protein, 30 aa, Artificial
  PRAME segment 4
ALELLPRELFPPLFMAAFDGRHSQTLKAMV

SEQ ID NO: 1331 - DNA, 90 bp, Artificial
  PRAME segment 5
  CDS (1)..(90)
gccgctttcgatggcagacactcccagacactgaaagccatggtgcaagcctggccctttacctgtctgcctctgggagtgctcatgaaa

SEQ ID NO: 1332 - protein, 30 aa, Artificial
  PRAME segment 5
AAFDGRHSQTLKAMVQAWPFTCLPLGVLMK

SEQ ID NO: 1333 - DNA, 90 bp, Artificial
  PRAME segment 6
  CDS (1)..(90)
caggcttggcctttcacatgcctccccctcggcgtcctgatgaagggacagcatctgcatctggaaacctttaaggctgtgctcgacgga

SEQ ID NO: 1334 - protein, 30 aa, Artificial
  PRAME segment 6
QAWPFTCLPLGVLMKGQHLHLETFKAVLDG

SEQ ID NO: 1335 - DNA, 90 bp, Artificial
  PRAME segment 7
  CDS (1)..(90)
ggccaacacctccacctcgagacattcaaagccgtcctggatggcctcgacgtcctgctcgcccaagaggtcaggcctaggagatggaaa

SEQ ID NO: 1336 - protein, 30 aa, Artificial
  PRAME segment 7
GQHLHLETFKAVLDGLDVLLAQEVRPRRWK

SEQ ID NO: 1337 - DNA, 90 bp, Artificial
  PRAME segment 8
  CDS (1)..(90)
ctggatgtgctcctggctcaggaagtgagacccagaaggtggaagctccaggtcctggatctgagaaagaatagccatcaggatttctgg

SEQ ID NO: 1338 - protein, 30 aa, Artificial
  PRAME segment 8
LDVLLAQEVRPRRWKLQVLDLRKNSHQDFW

SEQ ID NO: 1339 - DNA, 90 bp, Artificial
  PRAME segment 9
  CDS (1)..(90)
ctgcaagtgctcgacctcaggaaaaactcccaccaagacttttggacagtgtggagcggaaacagagcctccctgtatagctttcccgaa

SEQ ID NO: 1340 - protein, 30 aa, Artificial
  PRAME segment 9
LQVLDLRKNSHQDFWTVWSGNRASLYSFPE

SEQ ID NO: 1341 - DNA, 90 bp, Artificial
  PRAME segment 10
  CDS (1)..(90)
accgtctggtccggcaatagggctagcctctactccttccctgagcctgaggctgcccaacccatgaccaaaaagagaaaggtcgacgga

SEQ ID NO: 1342 - protein, 30 aa, Artificial
  PRAME segment 10
TVWSGNRASLYSFPEPEAAQPMTKKRKVDG

SEQ ID NO: 1343 - DNA, 90 bp, Artificial
  PRAME segment 11
  CDS (1)..(90)
cccgaagccgctcagcctatgacaaagaaaaggaaagtggatggcctcagcacagaggctgagcaaccctttatccctgtggaagtgctc

SEQ ID NO: 1344 - protein, 30 aa, Artificial
  PRAME segment 11
PEAAQPMTKKRKVDGLSTEAEQPFIPVEVL

SEQ ID NO: 1345 - DNA, 90 bp, Artificial
  PRAME segment 12
  CDS (1)..(90)
ctgtccaccgaagccgaacagcctttcattcccgtcgaggtcctggtcgacctcttcctcaaggaaggcgcttgcgatgagctcttctcc

SEQ ID NO: 1346 - protein, 30 aa, Artificial
  PRAME segment 12
LSTEAEQPFIPVEVLVDLFLKEGACDELFS

SEQ ID NO: 1347 - DNA, 90 bp, Artificial
  PRAME segment 13
  CDS (1)..(90)
gtggatctgtttctgaaagagggagcctgtgacgaactgtttagctatctgattgagaaagtgaaaaggaaaaagaatgtgctcaggctc

SEQ ID NO: 1348 - protein, 30 aa, Artificial
  PRAME segment 13
VDLFLKEGACDELFSYLIEKVKRKKNVLRL

SEQ ID NO: 1349 - DNA, 90 bp, Artificial
  PRAME segment 14
  CDS (1)..(90)
tacctcatcgaaaaggtcaagagaaagaaaaacgtcctgagactgtgttgcaaaaagctcaagattttcgctatgcctatgcaagacatt

SEQ ID NO: 1350 - protein, 30 aa, Artificial
  PRAME segment 14
YLIEKVKRKKNVLRLCCKKLKIFAMPMQDI

SEQ ID NO: 1351 - DNA, 90 bp, Artificial
  PRAME segment 15
  CDS (1)..(90)
tgctgtaagaaactgaaaatctttgccatgcccatgcaggatatcaaaatgattctgaaaatggtccagctcgactccatcgaagacctc

SEQ ID NO: 1352 - protein, 30 aa, Artificial
  PRAME segment 15
CCKKLKIFAMPMQDIKMILKMVQLDSIEDL

SEQ ID NO: 1353 - DNA, 90 bp, Artificial
  PRAME segment 16
  CDS (1)..(90)
aagatgatcctcaagatggtgcaactggatagcattgaggatctggaagtgacatgcacatggaaactgcctaccctcgccaaattctcc

SEQ ID NO: 1354 - protein, 30 aa, Artificial
  PRAME segment 16
KMILKMVQLDSIEDLEVTCTWKLPTLAKFS

SEQ ID NO: 1355 - DNA, 90 bp, Artificial
  PRAME segment 17
  CDS (1)..(90)
gaggtcacctgtacctggaagctccccacactggctaagtttagcccttacctcggccaaatgattaacctcaggagactgctcctgtcc

SEQ ID NO: 1356 - protein, 30 aa, Artificial
  PRAME segment 17
EVTCTWKLPTLAKFSPYLGQMINLRRLLLS

SEQ ID NO: 1357 - DNA, 90 bp, Artificial
  PRAME segment 18
  CDS (1)..(90)
ccctatctgggacagatgatcaatctgagaaggctcctgctcagccatatccatgcctccagctatatctcccccgaaaaggaagagcaa

SEQ ID NO: 1358 - protein, 30 aa, Artificial
  PRAME segment 18
PYLGQMINLRRLLLSHIHASSYISPEKEEQ

SEQ ID NO: 1359 - DNA, 90 bp, Artificial
  PRAME segment 19
  CDS (1)..(90)
cacattcacgctagctcctacattagccctgagaaagaggaacagtatatcgctcagtttacctcccagtttctgtccctgcaatgcctc

SEQ ID NO: 1360 - protein, 30 aa, Artificial
  PRAME segment 19
HIHASSYISPEKEEQYIAQFTSQFLSLQCL

SEQ ID NO: 1361 - DNA, 90 bp, Artificial
  PRAME segment 20
  CDS (1)..(90)
tacattgcccaattcacaagccaattcctcagcctccagtgtctgcaagccctctacgtcgactccctgtttttcctcaggggaaggctc

SEQ ID NO: 1362 - protein, 30 aa, Artificial
  PRAME segment 20
YIAQFTSQFLSLQCLQALYVDSLFFLRGRL

SEQ ID NO: 1363 - DNA, 90 bp, Artificial
  PRAME segment 21
  CDS (1)..(90)
caggctctgtatgtggatagcctcttctttctgagaggcagactggatcagctcctgagacacgtcatgaatcccctcgagacactgtcc

SEQ ID NO: 1364 - protein, 30 aa, Artificial
  PRAME segment 21
QALYVDSLFFLRGRLDQLLRHVMNPLETLS

SEQ ID NO: 1365 - DNA, 90 bp, Artificial
  PRAME segment 22
  CDS (1)..(90)
gaccaactgctcaggcatgtgatgaaccctctggaaaccctcagcattaccaattgcagactgtccgagggagacgtcatgcatctgtcc

SEQ ID NO: 1366 - protein, 30 aa, Artificial
  PRAME segment 22
DQLLRHVMNPLETLSITNCRLSEGDVMHLS

SEQ ID NO: 1367 - DNA, 90 bp, Artificial
  PRAME segment 23
  CDS (1)..(90)
atcacaaactgtaggctcagcgaaggcgatgtgatgcacctcagccaaagccctagcgtcagccaactgtccgtgctcagcctcagcgga

SEQ ID NO: 1368 - protein, 30 aa, Artificial
  PRAME segment 23
ITNCRLSEGDVMHLSQSPSVSQLSVLSLSG

SEQ ID NO: 1369 - DNA, 90 bp, Artificial
  PRAME segment 24
  CDS (1)..(90)
cagtccccctccgtgtcccagctcagcgtcctgtccctgtccggcgtcatgctcaccgatgtgtcccccgaacccctccaggctctgctc

SEQ ID NO: 1370 - protein, 30 aa, Artificial
  PRAME segment 24
QSPSVSQLSVLSLSGVMLTDVSPEPLQALL

SEQ ID NO: 1371 - DNA, 90 bp, Artificial
  PRAME segment 25
  CDS (1)..(90)
gtgatgctgacagacgtcagccctgagcctctgcaagccctcctggaaagggctagcgctaccctccaggatctggtcttcgatgagtgt

SEQ ID NO: 1372 - protein, 30 aa, Artificial
  PRAME segment 25
VMLTDVSPEPLQALLERASATLQDLVFDEC

SEQ ID NO: 1373 - DNA, 90 bp, Artificial
  PRAME segment 26
  CDS (1)..(90)
gagagagcctccgccacactgcaagacctcgtgtttgacgaatgcggaatcacagacgatcagctcctggctctgctcccctccctgtcc

SEQ ID NO: 1374 - protein, 30 aa, Artificial
  PRAME segment 26
ERASATLQDLVFDECGITDDQLLALLPSLS

SEQ ID NO: 1375 - DNA, 90 bp, Artificial
  PRAME segment 27
  CDS (1)..(90)
ggcattaccgatgaccaactgctcgccctcctgcctagcctcagccattgctcccagctcaccacactgtccttctatggcaatagcatt

SEQ ID NO: 1376 - protein, 30 aa, Artificial
  PRAME segment 27
GITDDQLLALLPSLSHCSQLTTLSFYGNSI

SEQ ID NO: 1377 - DNA, 90 bp, Artificial
  PRAME segment 28
  CDS (1)..(90)
cactgtagccaactgacaaccctcagcttttacggaaactccatctccatctccgccctccagtccctgctccagcatctgattggcctc

SEQ ID NO: 1378 - protein, 30 aa, Artificial
  PRAME segment 28
HCSQLTTLSFYGNSISISALQSLLQHLIGL

SEQ ID NO: 1379 - DNA, 90 bp, Artificial
  PRAME segment 29
  CDS (1)..(90)
agcattagcgctctgcaaagcctcctgcaacacctcatcggactgtccaacctcacccatgtgctctaccctgtgcctctggaaagctat

SEQ ID NO: 1380 - protein, 30 aa, Artificial
  PRAME segment 29
SISALQSLLQHLIGLSNLTHVLYPVPLESY

SEQ ID NO: 1381 - DNA, 90 bp, Artificial
  PRAME segment 30
  CDS (1)..(90)
agcaatctgacacacgtcctgtatcccgtccccctcgagtcctacgaagacattcacggaaccctccacctcgagagactggcttacctc

SEQ ID NO: 1382 - protein, 30 aa, Artificial
  PRAME segment 30
SNLTHVLYPVPLESYEDIHGTLHLERLAYL

SEQ ID NO: 1383 - DNA, 90 bp, Artificial
  PRAME segment 31
  CDS (1)..(90)
gaggatatccatggcacactgcatctggaaaggctcgcctatctgcatgccagactgagagagctcctgtgtgagctcggcagaccctcc

SEQ ID NO: 1384 - protein, 30 aa, Artificial
  PRAME segment 31
EDIHGTLHLERLAYLHARLRELLCELGRPS

SEQ ID NO: 1385 - DNA, 90 bp, Artificial
  PRAME segment 32
  CDS (1)..(90)
cacgctaggctcagggaactgctctgcgaactgggaaggcctagcatggtgtggctgtccgccaatccctgtccccattgcggagacaga

SEQ ID NO: 1386 - protein, 30 aa, Artificial
  PRAME segment 32
HARLRELLCELGRPSMVWLSANPCPHCGDR

SEQ ID NO: 1387 - DNA, 90 bp, Artificial
  PRAME segment 33
  CDS (1)..(90)
atggtctggctcagcgctaacccttgccctcactgtggcgataggacattctatgaccctgagcctatcctctgcccttgctttatgcct

SEQ ID NO: 1388 - protein, 30 aa, Artificial
  PRAME segment 33
MVWLSANPCPHCGDRTFYDPEPILCPCFMP

SEQ ID NO: 1389 - DNA, 54 bp, Artificial
  PRAME segment 34
  CDS (1)..(54)
accttttacgatcccgaacccattctgtgtccctgtttcatgcccaatgccgct

SEQ ID NO: 1390 - protein, 18 aa, Artificial
  PRAME segment 34
TFYDPEPILCPCFMPNAA

SEQ ID NO: 1391 - DNA, 90 bp, Artificial
  TRP2IN2 segment 1
  CDS (1)..(90)
gccgctctgatggagacacacctcagctccaagagatacacagaggaagccggaggctttttcccttggctcaaggtctactattacaga

SEQ ID NO: 1392 - protein, 30 aa, Artificial
  TRP2IN2 segment 1
AALMETHLSSKRYTEEAGGFFPWLKVYYYR

SEQ ID NO: 1393 - DNA, 90 bp, Artificial
  TRP2IN2 segment 2
  CDS (1)..(90)
gaggctggcggattctttccctggctgaaagtgtattactataggtttgtgattggcctcagggtctggcaatgggaagtgattagctgt

SEQ ID NO: 1394 - protein, 30 aa, Artificial
  TRP2IN2 segment 2
EAGGFFPWLKVYYYRFVIGLRVWQWEVISC

SEQ ID NO: 1395 - DNA, 84 bp, Artificial
  TRP2IN2 segment 3
  CDS (1)..(84)
ttcgtcatcggactgagagtgtggcagtgggaggtcatctcctgcaaactgattaagagagccacaaccagacagcctgccgct

SEQ ID NO: 1396 - protein, 28 aa, Artificial
  TRP2IN2 segment 3
FVIGLRVWQWEVISCKLIKRATTRQPAA

SEQ ID NO: 1397 - DNA, 90 bp, Artificial
  NYSO1a segment 1
  CDS (1)..(90)
gccgctatgcaagccgaaggcagaggcacaggcggaagcacaggcgatgccgatggccctggcggacccggaatccctgacggacccgga

SEQ ID NO: 1398 - protein, 30 aa, Artificial
  NYSO1a segment 1
AAMQAEGRGTGGSTGDADGPGGPGIPDGPG

SEQ ID NO: 1399 - DNA, 90 bp, Artificial
  NYSO1a segment 2
  CDS (1)..(90)
gacgctgacggacccggaggccctggcattcccgatggccctggcggaaacgctggcggacccggagaggctggcgctaccggaggcaga

SEQ ID NO: 1400 - protein, 30 aa, Artificial
  NYSO1a segment 2
DADGPGGPGIPDGPGGNAGGPGEAGATGGR

SEQ ID NO: 1401 - DNA, 90 bp, Artificial
  NYSO1a segment 3
  CDS (1)..(90)
ggcaatgccggaggccctggcgaagccggagccacaggcggaaggggacccagaggcgctggcgctgccagagcctccggccctggcgga

SEQ ID NO: 1402 - protein, 30 aa, Artificial
  NYSO1a segment 3
GNAGGPGEAGATGGRGPRGAGAARASGPGG

SEQ ID NO: 1403 - DNA, 90 bp, Artificial
  NYSO1a segment 4
  CDS (1)..(90)
ggccctaggggagccggagccgctagggctagcggacccggaggcggagcccctaggggaccccatggcggagccgctagcggactgaat

SEQ ID NO: 1404 - protein, 30 aa, Artificial
  NYSO1a segment 4
GPRGAGAARASGPGGGAPRGPHGGAASGLN

SEQ ID NO: 1405 - DNA, 90 bp, Artificial
  NYSO1a segment 5
  CDS (1)..(90)
ggcgctcccagaggccctcacggaggcgctgcctccggcctcaacggatgctgtaggtgtggcgctaggggacccgaaagcagactgctc

SEQ ID NO: 1406 - protein, 30 aa, Artificial
  NYSO1a segment 5
GAPRGPHGGAASGLNGCCRCGARGPESRLL

SEQ ID NO: 1407 - DNA, 90 bp, Artificial
  NYSO1a segment 6
  CDS (1)..(90)
ggctgttgcagatgcggagccagaggccctgagtccaggctcctggaattctatctggctatgcctttcgctacccctatggaagccgaa

SEQ ID NO: 1408 - protein, 30 aa, Artificial
  NYSO1a segment 6
GCCRCGARGPESRLLEFYLAMPFATPMEAE

SEQ ID NO: 1409 - DNA, 90 bp, Artificial
  NYSO1a segment 7
  CDS (1)..(90)
gagttttacctcgccatgccctttgccacacccatggaggctgagctcgccagaaggtccctggctcaggatgcccctcccctccccgtc

SEQ ID NO: 1410 - protein, 30 aa, Artificial
  NYSO1a segment 7
EFYLAMPFATPMEAELARRSLAQDAPPLPV

SEQ ID NO: 1411 - DNA, 90 bp, Artificial
  NYSO1a segment 8
  CDS (1)..(90)
ctggctaggagaagcctcgcccaagacgctccccctctgcctgtgcctggcgtcctgctcaaggaattcacagtgtccggcaatatcctc

SEQ ID NO: 1412 - protein, 30 aa, Artificial
  NYSO1a segment 8
LARRSLAQDAPPLPVPGVLLKEFTVSGNIL

SEQ ID NO: 1413 - DNA, 90 bp, Artificial
  NYSO1a segment 9
  CDS (1)..(90)
cccggagtgctcctgaaagagtttaccgtcagcggaaacattctgacaatcagactgacagccgctgaccataggcaactgcaactgtcc

SEQ ID NO: 1414 - protein, 30 aa, Artificial
  NYSO1a segment 9
PGVLLKEFTVSGNILTIRLTAADHRQLQLS

SEQ ID NO: 1415 - DNA, 90 bp, Artificial
  NYSO1a segment 10
  CDS (1)..(90)
accattaggctcaccgctgccgatcacagacagctccagctcagcattagctcctgcctccagcaactgtccctgctcatgtggatcaca

SEQ ID NO: 1416 - protein, 30 aa, Artificial
  NYSO1a segment 10
TIRLTAADHRQLQLSISSCLQQLSLLMWIT

SEQ ID NO: 1417 - DNA, 90 bp, Artificial
  NYSO1a segment 11
  CDS (1)..(90)
atctccagctgtctgcaacagctcagcctcctgatgtggattacccaatgctttctgcctgtgtttctggctcagcctccctccggccaa

SEQ ID NO: 1418 - protein, 30 aa, Artificial
  NYSO1a segment 11
ISSCLQQLSLLMWITQCFLPVFLAQPPSGQ

SEQ ID NO: 1419 - DNA, 57 bp, Artificial
  NYSO1a segment 12
  CDS (1)..(57)
cagtgtttcctccccgtcttcctcgcccaaccccctagcggacagagaagggctgcc

SEQ ID NO: 1420 - protein, 19 aa, Artificial
  NYSO1a segment 12
QCFLPVFLAQPPSGQRRAA

SEQ ID NO: 1421 - DNA, 90 bp, Artificial
  NYSO1b segment 1
  CDS (1)..(90)
gccgctatgctcatggctcaggaagccctcgcctttctgatggcccaaggcgctatgctcgccgctcaggaaaggagagtgcctagggct

SEQ ID NO: 1422 - protein, 30 aa, Artificial
  NYSO1b segment 1
AAMLMAQEALAFLMAQGAMLAAQERRVPRA

SEQ ID NO: 1423 - DNA, 90 bp, Artificial
  NYSO1b segment 2
  CDS (1)..(90)
cagggagccatgctggctgcccaagagagaagggtccccagagccgctgaggtccccggagcccaaggccaacagggacccagaggcaga

SEQ ID NO: 1424 - protein, 30 aa, Artificial
  NYSO1b segment 2
QGAMLAAQERRVPRAAEVPGAQGQQGPRGR

SEQ ID NO: 1425 - DNA, 90 bp, Artificial
  NYSO1b segment 3
  CDS (1)..(90)
gccgaagtgcctggcgctcagggacagcaaggccctaggggaagggaagaggctcccagaggcgtcaggatggccgctaggctccaggga

SEQ ID NO: 1426 - protein, 30 aa, Artificial
  NYSO1b segment 3
AEVPGAQGQQGPRGREEAPRGVRMAARLQG

SEQ ID NO: 1427 - DNA, 51 bp, Artificial
  NYSO1b segment 4
  CDS (1)..(51)
gaggaagcccctaggggagtgagaatggctgccagactgcaaggcgctgcc

SEQ ID NO: 1428 - protein, 17 aa, Artificial
  NYSO1b segment 4
EEAPRGVRMAARLQGAA

SEQ ID NO: 1429 - DNA, 90 bp, Artificial
  LAGE1 segment 1
  CDS (1)..(90)
gccgctatgcaagccgaaggccaaggcacaggcggaagcacaggcgatgccgatggccctggcggacccggaatccctgacggacccgga

SEQ ID NO: 1430 - protein, 30 aa, Artificial
  LAGE1 segment 1
AAMQAEGQGTGGSTGDADGPGGPGIPDGPG

SEQ ID NO: 1431 - DNA, 90 bp, Artificial; identical to SEQ ID NO: 1399
  LAGE1 segment 2
  CDS (1)..(90)

SEQ ID NO: 1432 - protein, 30 aa, Artificial; identical to SEQ ID NO: 1400
  LAGE1 segment 2

SEQ ID NO: 1433 - DNA, 90 bp, Artificial
  LAGE1 segment 3
  CDS (1)..(90)
ggcaatgccggaggccctggcgaagccggagccacaggcggaaggggacccagaggcgctggcgctgccagagcctccggccctagggga

SEQ ID NO: 1434 - protein, 30 aa, Artificial
  LAGE1 segment 3
GNAGGPGEAGATGGRGPRGAGAARASGPRG

SEQ ID NO: 1435 - DNA, 90 bp, Artificial
  LAGE1 segment 4
  CDS (1)..(90)
ggccctaggggagccggagccgctagggctagcggacccagaggcggagcccctaggggaccccatggcggagccgctagcgctcaggat

SEQ ID NO: 1436 - protein, 30 aa, Artificial
  LAGE1 segment 4
GPRGAGAARASGPRGGAPRGPHGGAASAQD

SEQ ID NO: 1437 - DNA, 90 bp, Artificial
  LAGE1 segment 5
  CDS (1)..(90)
ggcgctcccagaggccctcacggaggcgctgcctccgcccaagacggaaggtgtccctgtggcgctaggagacccgatagcagactgctc

SEQ ID NO: 1438 - protein, 30 aa, Artificial
  LAGE1 segment 5
GAPRGPHGGAASAQDGRCPCGARRPDSRLL

SEQ ID NO: 1439 - DNA, 90 bp, Artificial
  LAGE1 segment 6
  CDS (1)..(90)
ggcagatgcccttgcggagccagaaggcctgactccaggctcctgcaactgcatatcacaatgcctttctccagccctatggaagccgaa

SEQ ID NO: 1440 - protein, 30 aa, Artificial
  LAGE1 segment 6
GRCPCGARRPDSRLLQLHITMPFSSPMEAE

SEQ ID NO: 1441 - DNA, 90 bp, Artificial
  LAGE1 segment 7
  CDS (1)..(90)
cagctccacattaccatgccctttagctcccccatggaggctgagctcgtgagaaggattctgtccagggatgccgctcccctccccaga

SEQ ID NO: 1442 - protein, 30 aa, Artificial
  LAGE1 segment 7
QLHITMPFSSPMEAELVRRILSRDAAPLPR

SEQ ID NO: 1443 - DNA, 90 bp, Artificial
  LAGE1 segment 8
  CDS (1)..(90)
ctggtcaggagaatcctcagcagagacgctgcccctctgcctaggcctggcgctgtgctcaaggatttcacagtgtccggcaatctgctc

SEQ ID NO: 1444 - protein, 30 aa, Artificial
  LAGE1 segment 8
LVRRILSRDAAPLPRPGAVLKDFTVSGNLL

SEQ ID NO: 1445 - DNA, 90 bp, Artificial
  LAGE1 segment 9
  CDS (1)..(90)
cccggagccgtcctgaaagactttaccgtcagcggaaacctcctgtttatcagactgacagccgctgaccataggcaactgcaactgtcc

SEQ ID NO: 1446 - protein, 30 aa, Artificial
  LAGE1 segment 9
PGAVLKDFTVSGNLLFIRLTAADHRQLQLS

SEQ ID NO: 1447 - DNA, 90 bp, Artificial
  LAGE1 segment 10
  CDS (1)..(90)
ttcattaggctcaccgctgccgatcacagacagctccagctcagcattagctcctgcctccagcaactgtccctgctcatgtggatcaca

SEQ ID NO: 1448 - protein, 30 aa, Artificial
  LAGE1 segment 10
FIRLTAADHRQLQLSISSCLQQLSLLMWIT

SEQ ID NO: 1449 - DNA, 90 bp, Artificial
  LAGE1 segment 11
  CDS (1)..(90)
atctccagctgtctgcaacagctcagcctcctgatgtggattacccaatgctttctgcctgtgtttctggctcaggctccctccggccaa

SEQ ID NO: 1450 - protein, 30 aa, Artificial
  LAGE1 segment 11
ISSCLQQLSLLMWITQCFLPVFLAQAPSGQ

SEQ ID NO: 1451 - DNA, 57 bp, Artificial
  LAGE1 segment 12
  CDS (1)..(57)
cagtgtttcctccccgtcttcctcgcccaagcccctagcggacagagaagggctgcc

SEQ ID NO: 1452 - protein, 19 aa, Artificial
  LAGE1 segment 12
QCFLPVFLAQAPSGQRRAA

SEQ ID NO: 1453 - DNA, 10623 bp, Artificial
  Melanoma cancer specific savine
  CDS (1)..(10623)
gcccctgaggaagagatttgggaagagctcagcgtcatggaagtgtatgacggaagggaacactccgcctatggcgaacccagaaagctcgaggaagtgcctaccgctggctccaccgatccccctcagtccccccaaggcgctagcgctttccctaccacaatcaatttcacaaggcaaaccgtctggtccggcaatagggctagcctctactccttccctgagcctgaggctgcccaacccatgaccaaaaagagaaaggtcgacggacagattatgcctaaggctggcctcctgattatcgtcctggctatcattgccagagagggagactgtgcccctgaggaaaagatttgggaactgcaagtgctcgacctcaggaaaaactcccaccaagacttttggacagtgtggagcggaaacagagcctccctgtatagctttcccgaactggatgtgctcctggctcaggaagtgagacccagaaggtggaagctccaggtcctggatctgagaaagaatagccatcaggatttctggcagggagccatgctggctgcccaagagagaagggtccccagagccgctgaggtccccggagcccaaggccaacagggacccagaggcagacagtccccctccgtgtcccagctcagcgtcctgtccctgtccggcgtcatgctcaccgatgtgtcccccgaacccctccaggctctgctcctgacacaggatctggtccaggaaaagtatctggaatacagacaggtccccgatagcgatcccgctaggtatgagtttctgtggggccctaggcaaccctccgagggaagctccagcagagaggaagagggaccctccacctcctgcattctggaaagcctcttcagagccgtcatcacagccgctatggctgccagagccgtcttcctcgccctcagcgctcagctcctgcaagccagactgatgaaggaagagtcccccgtcgtgtccaccttttacgatcccgaacccattctgtgtccctgtttcatgcccaatgccgctatcgaactgatggaggtcgaccctatcggacacctctacattttcgctacctgtctgggactgtcctacgatggcctcctgggagacaataggagatacgtcgagcctcccgaaatgattggccctatgagacccgaacagtttagcgatgaggtcgagcctgccacacccgaagagggagaggctggcggattctttccctggctgaaagtgtattactataggtttgtgattggcctcagggtctggcaatgggaagtgattagctgtgccgctatggaaaggagaaggctctggggaagcattcagtccaggtatatctccatgtccgtgtggacctcccccagaaggctcgtggaagccgctctgatggagacacacctcagctccaagagatacacagaggaagccggaggctttttcccttggctcaaggtctactattacagagccgctatgtccctggaacagagaagcctccactgtaagcctgaggaagccctcgaggctcagcaagaggctctgggactggtctgcgtccaggctgccacaagctccagctcccccctcgtgctcggcacactggaagaggtccccacagccggaagcacagaccctccccaaagccctgccctcgagctcctgcctagggaactgtttccccctctgtttatggctgcctttgacggaaggcatagccaaaccctcaaggctatggtcgagctcagcgtcctggaagtgtttgagggaagggaagactccatcctcggcgatcccaaaaagctcctgacacagcatttcgtccaggaagagtccctgcaactggtcttcggaatcgatgtgaaagaggctgaccctaccggacactcctacgtcctggtcacctgtctgggactgtcccccgatccccctcagtccccccaaggcgctagctccctgcctaccacaatgaattaccctctgtggagccaaagctatgaggatagctccgccgctatgcaagccgaaggccaaggcacaggcggaagcacaggcgatgccgatggccctggcggacccggaatccctgacggacccggacagtgtttcctccccgtcttcctcgcccaaccccctagcggacagagaagggctgccacctggggcgaaggcctcccctcccagcctatcattcacacatgcgtctactttttcctccccgatcacctcagctttggcagaccctttagcacaagctgtatcctcgagtccctgtttagggctgtgattaccaaaaaggtcgccgatctggtcggctttctgctcctgaaatacagagccgctatgcaagccgaaggcagaggcacaggcggaagcacaggcgatgccgatggccctggcggacccggaatccctgacggacccggagacggacccgatggccaagagatggaccctcccaatcccgaagaggtcaagacacccgaagaggaaatgagaagccattacgtcgcccaaatctccagctgtctgcaacagctcagcctcctgatgtggattacccaatgctttctgcctgtgtttctggctcagcctccctccggccaagagagagcctccgccacactgcaagacctcgtgtttgacgaatgcggaatcacagacgatcagctcctggctctgctcccctccctgtccctgggagaccctaagaaactgctcacccaacactttgtgcaagagaattacctcgagtataggcaagtgcctggctccgaccctgcctgtgaggctctggaagcccaacaggaagccctcggcctcgtgtgtgtgcaagccgctacctccagctccagccctctggtcctgggaaccctcgagttttacctcgccatgccctttgccacacccatggaggctgagctcgccagaaggtccctggctcaggatgcccctcccctccccgtcgaggaagcccctaggggagtgagaatggctgccagactgcaaggcgctgcctggagactggaacccgaagacggaaccgctctgtgtttcattttcgctgccgagcaattctccgacgaagtggaacccgctacccctgaggaaggcgaacccgctacccaaaggcaagaccctgccgctgcccaagagggaaccatgaactatcccctctggtcccagtcctacgaagactccagcaatcaggaagaggaaggccctagcacattccctgacctcgagtccaaccaagaggaagagggaccctccacctttcccgatctggaaagcgaattccaagccgctctgtccaggaaagtggctgagctcgtgcatgtggatctgtttctgaaagagggagcctgtgacgaactgtttagctatctgattgagaaagtgaaaaggaaaaagaatgtgctcaggctcaccattaggctcaccgctgccgatcacagacagctccagctcagcattagctcctgcctccagcaactgtccctgctcatgtggatcacagccgctatgcctctggaacagagaagccaacactgtaagcctgaggaaggcctcgaggctaggggagaggctctgggactggtcggcgctgacgctgacggacccggaggccctggcattcccgatggccctggcggaaacgctggcggacccggagaggctggcgctaccggaggcagatacgaattcctctggggacccagagccctcgtggaaacctcctacgtcaaggtcctgcatcacatggtgaaaatctccggcggaccccatatcacaaactgtaggctcagcgaaggcgatgtgatgcacctcagccaaagccctagcgtcagccaactgtccgtgctcagcctcagcggaaactatctggaatacagacaggtccccggaagcgatcccgcttgctatgagtttctgtggggccctagggctctggtcgagacaagctatgtgattttctccaaggctagctccagcctccagctcgtgtttggcattgagctcatggaagtggatcccattggccatctgtatatctttcaggctctgtatgtggatagcctcttctttctgagaggcagactggatcagctcctgagacacgtcatgaatcccctcgagacactgtcctacattgcccaattcacaagccaattcctcagcctccagtgtctgcaagccctctacgtcgactccctgtttttcctcaggggaaggctcggccaacacctccacctcgagacattcaaagccgtcctggatggcctcgacgtcctgctcgcccaagaggtcaggcctaggagatggaaattcattaggctcaccgctgccgatcacagacagctccagctcagcattagctcctgcctccagcaactgtccctgctcatgtggatcacatgctgtaagaaactgaaaatctttgccatgcccatgcaggatatcaaaatgattctgaaaatggtccagctcgactccatcgaagacctcggcgctcccagaggccctcacggaggcgctgcctccggcctcaacggatgctgtaggtgtggcgctaggggacccgaaagcagactgctcaagaaagtggctgacctcgtgggattcctcctgctcaagtatagggctagggaacccgtcaccaaagccgaaatgctcgagtccgtgatttacgatggcctcctgggagacaatcagattatgcctaagacaggctttctgattatcgtcctggtcatgattgccatggagggaggccatagcattagcgctctgcaaagcctcctgcaacacctcatcggactgtccaacctcacccatgtgctctaccctgtgcctctggaaagctatatcgctagggaaggcgattgcgctcccgaagagaaaatctgggaggaactgtccgtgctcgaggtcttcgaaggcagagaggatagcattgaccaactgctcaggcatgtgatgaaccctctggaaaccctcagcattaccaattgcagactgtccgagggagacgtcatgcatctgtccagggctctggctgagacaagctatgtgaaagtgctcgagtatgtgattaaggtcagcgctagggtcaggtttttctttccctccctgagaagcaatctgacacacgtcctgtatcccgtccccctcgagtcctacgaagacattcacggaaccctccacctcgagagactggcttacctcgccgctatgctcatggctcaggaagccctcgcctttctgatggcccaaggcgctatgctcgccgctcaggaaaggagagtgcctagggctaagaattacaaacactgtttccctgagattttcggaaaggctagcgaaagcctccagctcgtgtttggcattgacgtcaaggaagccgataccctcgtggaagtgacactgggagaggtccccgctgccgaaagccctgaccctccccaaagccctcagggagcctccagcctccccacacacgctaggctcagggaactgctctgcgaactgggaaggcctagcatggtgtggctgtccgccaatccctgtccccattgcggagacagagtgatgctgacagacgtcagccctgagcctctgcaagccctcctggaaagggctagcgctaccctccaggatctggtcttcgatgagtgtgaggatgagggagcctccgccggacagggacccaaacccgaagccgatagccaagagcaaggccatccccaaaccggatgcgaatgcgaagagatgctgggaagcgtcgtgggaaactggcagtatttctttcccgtcatctttagcaaagcctccagctccctgcaactggtcttcggagccgctatgtcctggagaggcagaagcacatacagacccagacccagaaggtatgtggaaccccctgagatgatcggacccatgaggccttacattagcatgagcgtctggacaagccctaggagactggtcgagctcgccggacagtccctgctcaaggatgaggctctggctatcgcttacgatggcagagagcatagcgcttacggagagcctaggaaactgctcacccaagacctcgtgcaagagaaatacctcgagtataggcaacagtgtttcctccccgtcttcctcgcccaagcccctagcggacagagaagggctgccgtgaaagtgctccaccatatggtcaagattagcggaggccctcacattagctatccccctctgcatgagtgggtgctcagggaaggcgaacagctccacattaccatgccctttagctcccccatggaggctgagctcgtgagaaggattctgtccagggatgccgctcccctccccagacccggagtgctcctgaaagagtttaccgtcagcggaaacattctgacaatcagactgacagccgctgaccataggcaactgcaactgtccaagatgatcctcaagatggtgcaactggatagcattgaggatctggaagtgacatgcacatggaaactgcctaccctcgccaaattctccttcctcatcattgtgctcgtgatgatcgctatggaaggcggacacgctcccgaagaggaaatctgggaggaactgtccgtgatggaggtcgaggtcacctgtacctggaagctccccacactggctaagtttagcccttacctcggccaaatgattaacctcaggagactgctcctgtccgagggactggaagccagaggcgaagccctcggcctcgtgggagcccaagcccctgccacagaggaacaggaagccgctagctccagctccatctcctaccctcccctccacgaatgggtcctgagagagggagaggaagccgctcacattcacgctagctcctacattagccctgagaaagaggaacagtatatcgctcagtttacctcccagtttctgtccctgcaatgcctcggcaatgccggaggccctggcgaagccggagccacaggcggaaggggacccagaggcgctggcgctgccagagcctccggccctggcggaggccctaggggagccggagccgctagggctagcggacccggaggcggagcccctaggggaccccatggcggagccgctagcggactgaatcagggagcctccgcctttcccacaaccattaactttaccagacagagacagcctagcgaaggctccagctccagggaagaggaaggccctctggctaggagaagcctcgcccaagacgctccccctctgcctgtgcctggcgtcctgctcaaggaattcacagtgtccggcaatatcctcgccgctttcgatggcagacactcccagacactgaaagccatggtgcaagcctggccctttacctgtctgcctctgggagtgctcatgaaaatcaaagtgtccgccagagtgagattctttttccctagcctcagggaagccgctctgagagaggaagaggaaggcgtcgccgctggcattaccgatgaccaactgctcgccctcctgcctagcctcagccattgctcccagctcaccacactgtccttctatggcaatagcattgtgaaaacccctgaggaagagatgaggtcccactatgtggctcagacaggcattctgtggctgctcatgaataactgtttcctcaacctcatctccagctgtctgcaacagctcagcctcctgatgtggattacccaatgctttctgcctgtgtttctggctcaggctccctccggccaatacctcatcgaaaaggtcaagagaaagaaaaacgtcctgagactgtgttgcaaaaagctcaagattttcgctatgcctatgcaagacattgccagagagcctgtgacaaaggctgagatgctggaaagcgtcatcaaaaactataagcattgctttcccgaaatctttggcaaagcctccctggtcaggagaatcctcagcagagacgctgcccctctgcctaggcctggcgctgtgctcaaggatttcacagtgtccggcaatctgctccactgtagccaactgacaaccctcagcttttacggaaactccatctccatctccgccctccagtccctgctccagcatctgattggcctcatggtctggctcagcgctaacccttgccctcactgtggcgataggacattctatgaccctgagcctatcctctgcccttgctttatgcctgccgctagctggagccaaaagagaagctttgtgtatgtgtggaagacatggggagagggactgcctagccaacccattatccatacctgtctgctccaggctaggctcatgaaagaggaaagccctgtggtcagctggaggctcgagcctgaggatggcacagccctctgctttatctttgtgtatttctttctgcctgaccatctgtccttcggaaggcctttccatctgaatttctgtgactttctggctgccccctatctgggacagatgatcaatctgagaaggctcctgctcagccatatccatgcctccagctatatctcccccgaaaaggaagagcaacaggctcccgctaccgaagagcaagaggctgcctccagctccagcacactggtcgaggtcaccctcggcgaagtgcctgccgctgagtcccaggcttggcctttcacatgcctccccctcggcgtcctgatgaagggacagcatctgcatctggaaacctttaaggctgtgctcgacggactgtccaccgaagccgaacagcctttcattcccgtcgaggtcctggtcgacctcttcctcaaggaaggcgcttgcgatgagctcttctccgccgaagtgcctggcgctcagggacagcaaggccctaggggaagggaagaggctcccagaggcgtcaggatggccgctaggctccagggaggcgctcccagaggccctcacggaggcgctgcctccgcccaagacggaaggtgtccctgtggcgctaggagacccgatagcagactgctcggccctaggggagccggagccgctagggctagcggacccagaggcggagcccctaggggaccccatggcggagccgctagcgctcaggatctggctggccaaagcctcctgaaagacgaagccctcgccattgccgctctggaactgctccccagagagctcttccctcccctcttcatggagcctgccacacagagacaggatcccgctgccgctcaggaaggcgaagacgaaggcgctagcgctggccaaggccctaagcctgaggctcccgaagccgctcagcctatgacaaagaaaaggaaagtggatggcctcagcacagaggctgagcaaccctttatccctgtggaagtgctcggcagatgcccttgcggagccagaaggcctgactccaggctcctgcaactgcatatcacaatgcctttctccagccctatggaagccgaacccggagccgtcctgaaagactttaccgtcagcggaaacctcctgtttatcagactgacagccgctgaccataggcaactgcaactgtccgaggatatccatggcacactgcatctggaaaggctcgcctatctgcatgccagactgagagagctcctgtgtgagctcggcagaccctccgactcccaggaacagggacaccctcagacaggctgtgagtgtgaggatggccctgacggacaggaaatggatccccctaaccctgaggaattcgtcatcggactgagagtgtggcagtgggaggtcatctcctgcaaactgattaagagagccacaaccagacagcctgccgctgacgctgacggacccggaggccctggcattcccgatggccctggcggaaacgctggcggacccggagaggctggcgctaccggaggcagacccacaggccatagctatgtgctcgtgacatgcctcggcctcagctatgacggactgctcggcgataaccaaatcatgcccaaaaccggattcctcctgctcaagtatagggctagggaacccgtcaccaaagccgaaatgctcggctccgtggtcggcaattggcaatactttttccctaccggaatcctctggctcctgatgaacaattgctttctgaatctgtcccccagaaagcctgccgctgagtttcaggctgccctcagcagaaaggtcgccgaactggtccactttctgctcctgaaatacagagccagagagcctgtgacaaaggctgtgcctgactccgaccctgccagatacgaattcctctggggacccagagccctcgccgaaacctcctacgtcaaggtcctggaatacgtcggctgttgcagatgcggagccagaggccctgagtccaggctcctggaattctatctggctatgcctttcgctacccctatggaagccgaagccacatgcctcggcctcagctatgacggactgctcggcgataaccaaatcatgcccaaagccggactgctcatcattgtgctcgccattggcaatgccggaggccctggcgaagccggagccacaggcggaaggggacccagaggcgctggcgctgccagagcctccggccctagggga

SEQ ID NO: 1454 - protein, 3541 aa, Artificial
  Melanoma cancer specific savine
APEEEIWEELSVMEVYDGREHSAYGEPRKLEEVPTAGSTDPPQSPQGASAFPTTINFTRQTVWSGNRASLYSFPEPEAAQPMTKKRKVDGQIMPKAGLLIIVLAIIAREGDCAPEEKIWELQVLDLRKNSHQDFWTVWSGNRASLYSFPELDVLLAQEVRPRRWKLQVLDLRKNSHQDFWQGAMLAAQERRVPRAAEVPGAQGQQGPRGRQSPSVSQLSVLSLSGVMLTDVSPEPLQALLLTQDLVQEKYLEYRQVPDSDPARYEFLWGPRQPSEGSSSREEEGPSTSCILESLFRAVITAAMAARAVFLALSAQLLQARLMKEESPVVSTFYDPEPILCPCFMPNAAIELMEVDPIGHLYIFATCLGLSYDGLLGDNRRYVEPPEMIGPMRPEQFSDEVEPATPEEGEAGGFFPWLKVYYYRFVIGLRVWQWEVISCAAMERRRLWGSIQSRYISMSVWTSPRRLVEAALMETHLSSKRYTEEAGGFFPWLKVYYYRAAMSLEQRSLHCKPEEALEAQQEALGLVCVQAATSSSSPLVLGTLEEVPTAGSTDPPQSPALELLPRELFPPLFMAAFDGRHSQTLKAMVELSVLEVFEGREDSILGDPKKLLTQHFVQEESLQLVFGIDVKEADPTGHSYVLVTCLGLSPDPPQSPQGASSLPTTMNYPLWSQSYEDSSAAMQAEGQGTGGSTGDADGPGGPGIPDGPGQCFLPVFLAQPPSGQRRAATWGEGLPSQPIIHTCVYFFLPDHLSFGRPFSTSCILESLFRAVITKKVADLVGFLLLKYRAAMQAEGRGTGGSTGDADGPGGPGIPDGPGDGPDGQEMDPPNPEEVKTPEEEMRSHYVAQISSCLQQLSLLMWITQCFLPVFLAQPPSGQERASATLQDLVFDECGITDDQLLALLPSLSLGDPKKLLTQHFVQENYLEYRQVPGSDPACEALEAQQEALGLVCVQAATSSSSPLVLGTLEFYLAMPFATPMEAELARRSLAQDAPPLPVEEAPRGVRMAARLQGAAWRLEPEDGTALCFIFAAEQFSDEVEPATPEEGEPATQRQDPAAAQEGTMNYPLWSQSYEDSSNQEEEGPSTFPDLESNQEEEGPSTFPDLESEFQAALSRKVAELVHVDLFLKEGACDELFSYLIEKVKRKKNVLRLTIRLTAADHRQLQLSISSCLQQLSLLMWITAAMPLEQRSQHCKPEEGLEARGEALGLVGADADGPGGPGIPDGPGGNAGGPGEAGATGGRYEFLWGPRALVETSYVKVLHHMVKISGGPHITNCRLSEGDVMHLSQSPSVSQLSVLSLSGNYLEYRQVPGSDPACYEFLWGPRALVETSYVIFSKASSSLQLVFGIELMEVDPIGHLYIFQALYVDSLFFLRGRLDQLLRHVMNPLETLSYIAQFTSQFLSLQCLQALYVDSLFFLRGRLGQHLHLETFKAVLDGLDVLLAQEVRPRRWKFIRLTAADHRQLQLSISSCLQQLSLLMWITCCKKLKIFAMPMQDIKMILKMVQLDSIEDLGAPRGPHGGAASGLNGCCRCGARGPESRLLKKVADLVGFLLLKYRAREPVTKAEMLESVIYDGLLGDNQIMPKTGFLIIVLVMIAMEGGHSISALQSLLQHLIGLSNLTHVLYPVPLESYIAREGDCAPEEKIWEELSVLEVFEGREDSIDQLLRHVMNPLETLSITNCRLSEGDVMHLSRALAETSYVKVLEYVIKVSARVRFFFPSLRSNLTHVLYPVPLESYEDIHGTLHLERLAYLAAMLMAQEALAFLMAQGAMLAAQERRVPRAKNYKHCFPEIFGKASESLQLVFGIDVKEADTLVEVTLGEVPAAESPDPPQSPQGASSLPTHARLRELLCELGRPSMVWLSANPCPHCGDRVMLTDVSPEPLQALLERASATLQDLVFDECEDEGASAGQGPKPEADSQEQGHPQTGCECEEMLGSVVGNWQYFFPVIFSKASSSLQLVFGAAMSWRGRSTYRPRPRRYVEPPEMIGPMRPYISMSVWTSPRRLVELAGQSLLKDEALAIAYDGREHSAYGEPRKLLTQDLVQEKYLEYRQQCFLPVFLAQAPSGQRRAAVKVLHHMVKISGGPHISYPPLHEWVLREGEQLHITMPFSSPMEAELVRRILSRDAAPLPRPGVLLKEFTVSGNILTIRLTAADHRQLQLSKMILKMVQLDSIEDLEVTCTWKLPTLAKFSFLIIVLVMIAMEGGHAPEEEIWEELSVMEVEVTCTWKLPTLAKFSPYLGQMINLRRLLLSEGLEARGEALGLVGAQAPATEEQEAASSSSISYPPLHEWVLREGEEAAHIHASSYISPEKEEQYIAQFTSQFLSLQCLGNAGGPGEAGATGGRGPRGAGAARASGPGGGPRGAGAARASGPGGGAPRGPHGGAASGLNQGASAFPTTINFTRQRQPSEGSSSREEEGPLARRSLAQDAPPLPVPGVLLKEFTVSGNILAAFDGRHSQTLKAMVQAWPFTCLPLGVLMKIKVSARVRFFFPSLREAALREEEEGVAAGITDDQLLALLPSLSHCSQLTTLSFYGNSIVKTPEEEMRSHYVAQTGILWLLMNNCFLNLISSCLQQLSLLMWITQCFLPVFLAQAPSGQYLIEKVKRKKNVLRLCCKKLKIFAMPMQDIAREPVTKAEMLESVIKNYKHCFPEIFGKASLVRRILSRDAAPLPRPGAVLKDFTVSGNLLHCSQLTTLSFYGNSISISALQSLLQHLIGLMVWLSANPCPHCGDRTFYDPEPILCPCFMPAASWSQKRSFVYVWKTWGEGLPSQPIIHTCLLQARLMKEESPVVSWRLEPEDGTALCFIFVYFFLPDHLSFGRPFHLNFCDFLAAPYLGQMINLRRLLLSHIHASSYISPEKEEQQAPATEEQEAASSSSTLVEVTLGEVPAAESQAWPFTCLPLGVLMKGQHLHLETFKAVLDGLSTEAEQPFIPVEVLVDLFLKEGACDELFSAEVPGAQGQQGPRGREEAPRGVRMAARLQGGAPRGPHGGAASAQDGRCPCGARRPDSRLLGPRGAGAARASGPRGGAPRGPHGGAASAQDLAGQSLLKDEALAIAALELLPRELFPPLFMEPATQRQDPAAAQEGEDEGASAGQGPKPEAPEAAQPMTKKRKVDGLSTEAEQPFIPVEVLGRCPCGARRPDSRLLQLHITMPFSSPMEAEPGAVLKDFTVSGNLLFIRLTAADHRQLQLSEDIHGTLHLERLAYLHARLRELLCELGRPSDSQEQGHPQTGCECEDGPDGQEMDPPNPEEFVIGLRVWQWEVISCKLIKRATTRQPAADADGPGGPGIPDGPGGNAGGPGEAGATGGRPTGHSYVLVTCLGLSYDGLLGDNQIMPKTGFLLLKYRAREPVTKAEMLGSVVGNWQYFFPTGILWLLMNNCFLNLSPRKPAAEFQAALSRKVAELVHFLLLKYRAREPVTKAVPDSDPARYEFLWGPRALAETSYVKVLEYVGCCRCGARGPESRLLEFYLAMPFATPMEAEATCLGLSYDGLLGDNQIMPKAGLLIIVLAIGNAGGPGEAGATGGRGPRGAGAARASGPRG

SEQ ID NO: 1455 - DNA, 99 bp, Artificial
  Figure 16 A1S1 99mer
ggcggatccaccatgacaggcccttgcamaaacgtcagcwccgtgcaatgcacacacggaatcaracccgtcgtgtccacccaactgctcctgaatggc

SEQ ID NO: 1456 - DNA, 100 bp, Artificial
  Figure 16 A1S2 100mer
gggcttcctttgtgtccytgacstcaatcctttggtggacgcaccacagtgtggcgayggtattgwagaggcttytcagggagccattcaggagcagttg

SEQ ID NO: 1457 - DNA, 100 bp, Artificial
  Figure 16 A1S3 100mer
cagtgtgatttgtggaaagytgarggagctggaggtgccttgcctwtcagcgcctccgccatcgccgagttcgattttgtcgagggcttcctttgtgtcc

SEQ ID NO: 1458 - DNA, 100 bp, Artificial
  Figure 16 A1S4 100mer
atacagatcgtccatgtactggtaaatcaccatwtcgggattctktwttctgaagggttcggtgaccagaggcctttgccacagtgtgatttgtggaaag

SEQ ID NO: 1459 - DNA, 100 bp, Artificial
  Figure 16 A1S5 100mer
catccagaggaatggtggttccttttggtgtttcttatcgggtgtggtaaaatgctgtccgatttccagatcgcttcccacatacagatcgtccatgtac

SEQ ID NO: 1460 - DNA, 99 bp, Artificial
  Figure 16 A1S6 100mer
ccaccattcctctggatgggatacgaactgcatcccgataggtggaccgtccagcctyttartttccctcagattaccctctggcagcgtcccctcgtg

SEQ ID NO: 1461 - DNA, 99 bp, Artificial; identical to SEQ ID NO: 1460
  Figure 16 A1S7 100mer

SEQ ID NO: 1462 - DNA, 100 bp, Artificial
  Figure 16 A1S8 100mer
gaaacgtaggcaacgtagasgcgctcctcagagcagmraggatcaccaataccctatcyctgagcaacccctcyccttctttagggaaaacctggctttc

SEQ ID NO: 1463 - DNA, 100 bp, Artificial
  Figure 16 A1S9 100mer
gggaaaacctggctttccmgcaaggtraagccagagagtttyccagcgaacagacargagccaatagcyccrcctccaggaagagcccccaaatctccgg

SEQ ID NO: 1464 - DNA, 76 bp, Artificial
  Figure 16 A1S10 75mer
ggcgaattcactagtagcggcgtttttggtgccagrtcccagaaygrcggagctttcgccggagatttgggggctc

SEQ ID NO: 1465 - DNA, 20 bp, Artificial
  Figure 16 A1F 20mer
ggcggatccaccatgacagg

SEQ ID NO: 1466 - DNA, 20 bp, Artificial
  Figure 16 A1R 20mer
ggcgaattcactagtagcgg

SEQ ID NO: 1467 - protein, 16 aa, Artificial
  Invasin immunostimulatory domain
TAKSKKFPSYTATYQF

SEQ ID NO: 1468 - protein, 490 aa, Human immunodeficiency virus
MGARASVLSGGKLDAWEKIRLRPGGKKKYKMKHLVWASRELERFALNPGLLETAEGCQQLIEQLQSTLKTGSEELKSLYNTIATLWCVHQRIEVKDTKEALDKIEEVQKKSQQKKQQAAADTGSSSKVSQNYPIVQNAQGQMVHQPLSPRTLNAWVKVIEEKGFNPEVIPMFSALSEGATPQDLNMMLNIVGGHQAAMQMLKETINEEAAEWDRVHPVHAGPIPPGQMREPRGSDIAGTTSTLQEQIGWMTNNPPIPVGDIYKRWIILGLNKIVRMYQPVSILDIRQGPKEPFRDYVDRFYKVLRAEQATQEVKNWMTETLLVQNANPDCKSILKALGTGATLEEMMTACQGVGGPSHKARVLAEAMSQAQHANIMMQRGNFKGQTRIKCFNCGKEGHLARNCRAPRKKGCWKCGKEGHQMKDCTERQANFLGKIWPSNKGRPGNFPQSKPEPTAPPAENWGMGEEQKDKEHPPPSVSLKSLFGNDPLSQ

SEQ ID NO: 1469 - protein, 516 aa, Artificial
  GAG Consensus A
  MISC_FEATURE (114)..(119): X = unkown amino acid
  MISC_FEATURE (126)..(126): X = unkown amino acid
  MISC_FEATURE (130)..(130): X = unkown amino acid
  MISC_FEATURE (135)..(138): X = unkown amino acid
  MISC_FEATURE (153)..(153): X = unkown amino acid
  MISC_FEATURE (156)..(156): X = unkown amino acid
  MISC_FEATURE (348)..(348): X = unkown amino acid
  MISC_FEATURE (381)..(383): X = unkown amino acid
  MISC_FEATURE (386)..(387): X = unkown amino acid
  MISC_FEATURE (401)..(401): X = unkown amino acid
  MISC_FEATURE (440)..(440): X = unkown amino acid
  MISC_FEATURE (475)..(475): X = unkown amino acid
  MISC_FEATURE (477)..(477): X = unkown amino acid
  MISC_FEATURE (486)..(486): X = unkown amino acid
  MISC_FEATURE (494)..(495): X = unkown amino acid
  MISC_FEATURE (498)..(499): X = unkown amino acid
  MISC_FEATURE (503)..(503): X = unkown amino acid
MGARASVLSGGKLDAWEKIRLRPGGKKKYRLKHLVWASRELERFALNPSLLETAEGCQQIMEQLQSALKTGEELKSLFNTVATLYCVHQRIDVKDTKEALDKIEEIQNKSKQKXXXXXXTQQAAAXTGSXSSKVXXXXSQNYPIVQNAQGQMXHQXLSPRTLNAWVKVIEEKAFSPEVIPMFSALSEGATPQDLNMMLNIVGGHQAAMQMLKDTINEEAAEWDRHPVHAGPIPPGQMREPRGSDIAGTTSTLQEQIGWMTSNPPIPVGDIYKRWIILGLNKIVRMYSPVSILDIRQGPKEPFRDYVDRFFKTLRAEQATQEVKNWMTETLLVQNANPDCKSILRALGXGATLEEMMTACQGVGGPGHKARVLAEAMSQVQXXXNCXXIMMQRGNFRGQKRXIKCFNCGKEGHLARNCRAPRKKGCWKCGKEGHQMKDCTXERQANFLGKIWPSSKGRPGNFPQSRPEPTAPPAEXFXGMGEEITSXPKQEQKDXXKEXXPPLXSLKSLFGNDPLSQ

SEQ ID NO: 1470 - protein, 995 aa, Human immunodeficiency virus
FFRENLAFQQGKAREFSSEQTGANSSASRKLGDGGGAERQGTSSSFSFPQITLWQRPLVTIKIGGQLKEALLDTGADDTVLEDINLPGKWKPKMIGGIGGFIKVRQYDQILIEICGKKAIGTVLVGPTPVNIIGRNMLTQIGCTLNFPISPIDTVPVKLKPGMDGPKVKQWPLTEEKIKALTEICKEMEEEGKISKIGPENPYNTPVFAIKKKDSTKWRKLVDFRELNKRTQDFWEVQLGIPHPAGLKKKKSVTVLDVGDAYFSVPLDESFRKYTAFTIPSINNETPGIRYQYNVLPQGWKGSPAIFQSSMTKILEPFRIKNPEMVIYQYMDDLYVGSDLEIGQHRTKIEELRAHLLSWGFTTPDKKHQKEPPFLWMGYELHPDRWTVQPIELPEKDSWTVNDIQKLVGKLNWASQIYAGIKVKQLCKLLRGTKALTDIVPLTEEAELELEENREILRIPVHGVYYDPSKDLVAEVQKQGQDQWTYQIYQEPFKNLKTGKYSRKRSAHTNDVRQLTEVVQKIATESIVIWGKTPKFRLPIQRETWETWWMEYWQATWIPEWEFVNTPPLVKLWYQLEKDPIVGAETFYVDGAASRETKLGKAGYVTDRGRQKVISLTETTNQKTELHAIHLALQDSGSEVNIVTDSQYALGIIQAQPDRSESEVVSQIIEELIKKEKVYLSWVPAHKGIGGNEQVDKLVISGIRKVLFLDGINKAQEEHERYHSNWRTMASDFNLPPIVAKEIVANCDKCQLKGEAMHGQVDCSPGIWQLDCTHLEGKVILVAVHVASGYIEAEVIPAETGQETAYFLLKLAGRWPVKVIHTDNGSNFTSAAVKAACWWANVRQEFGIPYNPQSQGVVESMNKELKKIIGQVREQAEHLKTAVQMAVFIHNFKRKGGIGGYSAGERIIDIIATDIQTKELQKQITKIQNFRVYYRDSRDPIWKGPAKLLWKGEGAVVIQDNSDIKVVPRRKAKIIRDYGKQMAGDDCVAGRQDED

SEQ ID NO: 1471 - protein, 1006 aa, Artificial
  POL Consensus A
  MISC_FEATURE (15)..(15): X = unknown amino acid
  MISC_FEATURE (22)..(23): X = unknown amino acid
  MISC_FEATURE (26)..(26): X = unknown amino acid
  MISC_FEATURE (30)..(30): X = unknown amino acid
  MISC_FEATURE (36)..(36): X = unknown amino acid
  MISC_FEATURE (38)..(39): X = unknown amino acid
  MISC_FEATURE (41)..(44): X = unknown amino acid
  MISC_FEATURE (46)..(46): X = unknown amino acid
  MISC_FEATURE (48)..(48): X = unknown amino acid
  MISC_FEATURE (51)..(51): X = unknown amino acid
  MISC_FEATURE (53)..(55): X = unknown amino acid
  MISC_FEATURE (58)..(58): X = unknown amino acid
  MISC_FEATURE (73)..(73): X = unknown amino acid
  MISC_FEATURE (75)..(75): X = unknown amino acid
  MISC_FEATURE (105)..(105): X = unknown amino acid
  MISC_FEATURE (130)..(130): X = unknown amino acid
  MISC_FEATURE (173)..(173): X = unknown amino acid
  MISC_FEATURE (194)..(194): X = unknown amino acid
  MISC_FEATURE (197)..(197): X = unknown amino acid
  MISC_FEATURE (255)..(255): X = unknown amino acid
  MISC_FEATURE (280)..(281): X = unknown amino acid
  MISC_FEATURE (293)..(293): X = unknown amino acid
  MISC_FEATURE (300)..(300): X = unknown amino acid
  MISC_FEATURE (316)..(316): X = unknown amino acid
  MISC_FEATURE (320)..(320): X = unknown amino acid
  MISC_FEATURE (331)..(333): X = unknown amino acid
  MISC_FEATURE (335)..(335): X = unknown amino acid
  MISC_FEATURE (365)..(365): X = unknown amino acid
  MISC_FEATURE (369)..(369): X = unknown amino acid
  MISC_FEATURE (373)..(373): X = unknown amino acid
  MISC_FEATURE (402)..(403): X = unknown amino acid
  MISC_FEATURE (434)..(434): X = unknown amino acid
  MISC_FEATURE (439)..(439): X = unknown amino acid
  MISC_FEATURE (452)..(452): X = unknown amino acid
  MISC_FEATURE (470)..(470): X = unknown amino acid
  MISC_FEATURE (480)..(480): X = unknown amino acid
  MISC_FEATURE (487)..(487): X = unknown amino acid
  MISC_FEATURE (514)..(514): X = unknown amino acid
  MISC_FEATURE (534)..(535): X = unknown amino acid
  MISC_FEATURE (544)..(544): X = unknown amino acid
  MISC_FEATURE (553)..(553): X = unknown amino acid
  MISC_FEATURE (558)..(558): X = unknown amino acid
  MISC_FEATURE (593)..(593): X = unknown amino acid
  MISC_FEATURE (610)..(610): X = unknown amino acid
  MISC_FEATURE (675)..(675): X = unknown amino acid
  MISC_FEATURE (685)..(685): X = unknown amino acid
  MISC_FEATURE (687)..(687): X = unknown amino acid
  MISC_FEATURE (712)..(712): X = unknown amino acid
  MISC_FEATURE (729)..(729): X = unknown amino acid
  MISC_FEATURE (732)..(732): X = unknown amino acid
  MISC_FEATURE (735)..(735): X = unknown amino acid
  MISC_FEATURE (738)..(738): X = unknown amino acid
  MISC_FEATURE (749)..(749): X = unknown amino acid
  MISC_FEATURE (759)..(759): X = unknown amino acid
  MISC_FEATURE (763)..(763): X = unknown amino acid
  MISC_FEATURE (775)..(775): X = unknown amino acid
  MISC_FEATURE (790)..(790): X = unknown amino acid
  MISC_FEATURE (847)..(847): X = unknown amino acid
  MISC_FEATURE (853)..(854): X = unknown amino acid
  MISC_FEATURE (885)..(885): X = unknown amino acid
  MISC_FEATURE (924)..(924): X = unknown amino acid
  MISC_FEATURE (936)..(936): X = unknown amino acid
  MISC_FEATURE (999)..(999): X = unknown amino acid
FFRENLAFQQGEARXFSSEQTXXNSXTSRXLWDGGXDXXLXXXXGXEXQGXGXXXSFXFPQITLWQRPLVTVXIXGQLIEALLDTGADDTVLEDINLPGKWKPKXIGGIGGFIKVRQYDQILIEICGKKXIGTVLVGPTPVNIIGRNMLTQIGCTLNFPISPIETVPVKLKPXMDGPKVKQWPLTEEKIKALTXICXEMEKEGKISKIGPENPYNTPVFAIKKKDSTKWRKLVDFRELNKRTQDFWEVQLGIPHXAGLKKKKSVTVLDVGDAYFSVPLDXXFRKYTAFTIPSXNNETPGXRYQYNVLPQGWKGSPXIFQXSMTKILEPFRXXXPXIVIYQYMDDLYVGSDLEIGQHRAKIEELRXHLLXWGFXTPDKKHQKEPPFLWMGYELHPDKWTVQPXXLPEKDSWTVNDIQKLVGKLNWASQIYAGIKXKQLCXLLRGAKALTDIVXLTEEAELELAENREILKXPVHGVYYDPXKDLVAEXQKQGQDQWTYQIYQEPFKNLKTGKYAXKRSAHTNDVKQLTEVVQKVXXESIVIWGKXPKFRLPIQXETWEXWWMEYWQATWIPEWEFVNTPPLVKLWYQLEKDPIXGAETFYVDGAANRETKXGKAGYVTDRGRQKVVSLTETTNQKTELHAIHLALQDSGSEVNIVTDSQYALGIIQAQPDRSESEXVNQIIEKLIXKXKVYLSWVPAHKGIGGNEQVDKLVSXGIRKVLFLDGIDKAQEXHEXYHXNWXAMASDFNLPPXVAKEIVASCXKCQXKGEAMHGQVDCXPGIWQLDCTHLEGKXILVAVHVASGYIEAEVIPAETGQETAYFILKLAGRWPVKVIHTDNGSNFTSAAVKAXCWWANXXQEFGIPYNPQSQGVVESMNKELKKIIGQVRXQAEHLKTAVQMAVFIHNFKRKGGIGGYSAGERIIDIIAXDIQTKELQKQIXKIQNFRVYYRDSRDPIWKGPAKLLWKGEGAVVIQDNSDIKVVPRRKAKIIRDYGKQMAGDDCXAGRQDED

SEQ ID NO: 1472 - protein, 192 aa, Human immunodeficiency virus
MENRWQVMIVWQVDRMRIRTWNSLVKHHMYISKKAKQWFYRHHYESQHPKVSSEVHIPLGEARLVIRTYWGLQTGEKDWQLGHGVSIEWRQKRYSTQIDPDLADQLIHLQYFDCFSDSTIRRAILGQVVRRRCEYPSGHNKVGSLQYLALKALTTPKRIRPPLPSVKKLTEDRWNKPQKIKGHRENPTMNGH

SEQ ID NO: 1473 - protein, 192 aa, Artificial
  VIF Consensus A
  MISC_FEATURE (188)..(188): X = unknown amino acid
MENRWQVMIVWQVDRMRIRTWNSLVKHHMYVSKKAKGWFYRHHFESRHPKVSSEVHIPLGDARLVVRTYWGLHTGERDWHLGHGVSIEWRQKRYSTQVDPDLADQLIHLHYFDCFSDSAIRKAILGEIVRPRCEYQAGHNKVGSLQYLALKALVAPTKAKPPLPSVKKLTEDRWNEPQKTRGHRGSRXMNGH

SEQ ID NO: 1474 - protein, 192 aa, Human immunodeficiency virus
MENRWQVLIVWQVDRMKIRTWNSLVKHHMHISRRANGWVYRHHYDSRHPKVSSEVHIPLGEARLIIKTYWGLQTGERDWHLGHGVSIEWRLRSYNTQVDPGLADHLIHMHYFDCFAESAIRKAILGYRVSPRCDYQAGHNKVGSLQYLALTALIKPKKAKPPLPSVSKLVEDKWNKPQKTRGRRGNHTMNGH

SEQ ID NO: 1475 - protein, 96 aa, Human immunodeficiency virus; identical to SEQ ID NO: 4

SEQ ID NO: 1476 - protein, 96 aa, Artificial
  VPR Consensus A
  MISC_FEATURE (3)..(3): X = unknown amino acid
  MISC_FEATURE (15)..(16): X = unknown amino acid
  MISC_FEATURE (18)..(19): X = unknown amino acid
  MISC_FEATURE (30)..(30): X = unknown amino acid
  MISC_FEATURE (37)..(37): X = unknown amino acid
  MISC_FEATURE (48)..(48): X = unknown amino acid
  MISC_FEATURE (58)..(58): X = unknown amino acid
  MISC_FEATURE (70)..(70): X = unknown amino acid
  MISC_FEATURE (85)..(85): X = unknown amino acid
  MISC_FEATURE (94)..(94): X = unknown amino acid
MEXAPEDQGPQREPXXEXXLELLEELKHEXVRHFPRXWLHGLGQHIYXTYGDTWEGVXAIIRILQQLLFXHFRIGCQHSRIGIIXGRRGRNGAXRS

SEQ ID NO: 1477 - protein, 94 aa, Human immunodeficiency virus
MEQAPEDQSSQREPYNEWTLELLEELKNEAVRHFPRPWLHGLGQYIYNNYGDTWEGVEAIIRILQQLLFVHFRIGCQHSRIGIFAREKRQEWSW

SEQ ID NO: 1478 - protein, 102 aa, Human immunodeficiency virus
MELVDPNLEPWNHPGSQPTTACSKCYCKKCCWHCQLCFLKKGLGISHGRKKRKHRRGTPQSRKDHQYPIPEQPLPIIRGGNPTDPKESKKEVASKAETDPCD

SEQ ID NO: 1479 - protein, 103 aa, Artificial
  TAT Consensus A
  MISC_FEATURE (2)..(2): X = unknown amino acid
  MISC_FEATURE (29)..(29): X = unknown amino acid
  MISC_FEATURE (54)..(55): X = unknown amino acid
  MISC_FEATURE (63)..(63): X = unknown amino acid
  MISC_FEATURE (81)..(82): X = unknown amino acid
  MISC_FEATURE (103)..(103): X = unknown amino acid
MXPVDPNLEPWNHPGSQPTTACSKCYCKXCCWHCQLCFLNKGLGISYGRKKRRXXRRGTPQSXKDHQNPIPKQPLPQTQGXXPTGPKESKKKVESKTETDRFX

SEQ ID NO: 1480 - protein, 124 aa, Human immunodeficiency virus
MAGRSGSTDEELLRAVRIINILYQSNPYPSSEGGTRQTRKNRRRRWRARQRQIRAISERILSTCLGRSTEPVPLQLPPLERLHLDCSEDCGTSGTQQSQGTETGVGRPQISGESSVILGPGTKN

SEQ ID NO: 1481 - protein, 122 aa, Artificial
  REV Consensus A
  MISC_FEATURE (96)..(96): X = unknown amino acid
  MISC_FEATURE (99)..(99): X = unknown amino acid
MAGRSGSDEELLKAIRIIKILYQSNPYPKPKGSRQARKNRRRRWRARQRQIDSLSERILSTCLGRPAEPVPLQLPPLERLHLDCSEDCGTSGTQQXQGXETGVGRPQVSVESSAVLGSGTKN

SEQ ID NO: 1482 - protein, 107 aa, Human immunodeficiency virus
MAGRSGDSDEELLKAVRIIKILYQSNPYPTPEGTRQARRNRRRRWRARQRQIHTLSERILSNFLGRPAEPVPLQLPPLERLNLDCSEDSDTSGTQQSQGTTEGVGNP

SEQ ID NO: 1483 - protein, 85 aa, Artificial
  VPU Consensus A
  MISC_FEATURE (5)..(7): X = unknown amino acid
  MISC_FEATURE (46)..(46): X = unknown amino acid
  MISC_FEATURE (62)..(62): X = unknown amino acid
  MISC_FEATURE (66)..(66): X = unknown amino acid
  MISC_FEATURE (69)..(69): X = unknown amino acid
MTPLXXXEICAIVGLIVALILAIVVWTIVGIEYKKLLKQRKIDRLXIKRIRERAEDSGNESXGDTXELXKLVEMGNYDLGVDNNL

SEQ ID NO: 1484 - protein, 86 aa, Human immunodeficiency virus
MVDLLAKVDYRIVIVAFIVALIIAIVVWTIAYIEYRKLLRQRRIDRLIKRTRERAEDSGNESDGDTEELSTMVDMGNLRLLDVNDL

SEQ ID NO: 1485 - protein, 724 aa, Artificial
  ENV Consensus A
  MISC_FEATURE (9)..(9): X = unknown amino acid
  MISC_FEATURE (14)..(14): X = unknown amino acid
  MISC_FEATURE (30)..(30): X = unknown amino acid
  MISC_FEATURE (37)..(37): X = unknown amino acid
  MISC_FEATURE (75)..(75): X = unknown amino acid
  MISC_FEATURE (77)..(87): X = unknown amino acid
  MISC_FEATURE (89)..(89): X = unknown amino acid
  MISC_FEATURE (89)..(100): X = unknown amino acid
  MISC_FEATURE (102)..(102): X = unknown amino acid
  MISC_FEATURE (104)..(110): X = unknown amino acid
  MISC_FEATURE (112)..(124): X = unknown amino acid
  MISC_FEATURE (126)..(127): X = unknown amino acid
  MISC_FEATURE (160)..(174): X = unknown amino acid
  MISC_FEATURE (176)..(184): X = unknown amino acid
  MISC_FEATURE (223)..(223): X = unknown amino acid
  MISC_FEATURE (226)..(226): X = unknown amino acid
  MISC_FEATURE (245)..(245): X = unknown amino acid
  MISC_FEATURE (263)..(267): X = unknown amino acid
  MISC_FEATURE (285)..(286): X = unknown amino acid
  MISC_FEATURE (289)..(289): X = unknown amino acid
  MISC_FEATURE (303)..(305): X = unknown amino acid
  MISC_FEATURE (309)..(311): X = unknown amino acid
  MISC_FEATURE (316)..(317): X = unknown amino acid
  MISC_FEATURE (322)..(322): X = unknown amino acid
  MISC_FEATURE (371)..(372): X = unknown amino acid
  MISC_FEATURE (479)..(480): X = unknown amino acid
  MISC_FEATURE (500)..(500): X = unknown amino acid
  MISC_FEATURE (504)..(504): X = unknown amino acid
  MISC_FEATURE (583)..(583): X = unknown amino acid
  MISC_FEATURE (586)..(587): X = unknown amino acid
  MISC_FEATURE (677)..(677): X = unknown amino acid
DAKAYDTEXHNVWXATHACVPTDPNPQEIXLENVTEXFNMWKNNMVEQMHEDIISLWDQSLKPCVKLTPLCVTLXCXXXXXXXXXXXNXTXXXXXXXXXXNXTXXXXXXXNXXXXXXXXXXXXXMXXEIKNCSFNMTTELRDKKQKVYSLFYRLDVVQIXXXXXXXXNXXXXXXNXXXXXXXXXYRLINCNTSAITQACPKVSFEPIPIHYCAPAGFAILKCXDKXFNGTGPCKNVSTVQCTHGXIKPVVSTQLLLNGSLAEXXXVXIRSENITNNAKTIIVQLXXPVXINCTRPNNNTRKSXXXVRIXXXGPGQXXAFYAXNETFRPGGGDMRDNWRSELYKYKVVKIEPLGVAPTRAKRRVVEREKRAXXVGLGAVFLGFLGAAGSTMGAASITLTVQARQLLSGIVQQQSNLLRAIEAQQHLLKLTVWGIKQLQARVLAVERYLRDQQLLGIWGCSGKLICTTNVPWNSSWSNKSXXDIWDNMTWLQWDKEISNYTXIIYXLIEESQNQQEKNEQDLLALDKWANLWNWFDISNWLWYIRIFIMIVGGLIGLRIVFAVLSIINRVRQGYSPLSFQTLTPXPRXXPDRPERIEEEGGEQDRDRSIRLVSGFLALAWDDLRSLCLFSYHRLRDFILIAARTVELLGHSSLKGLRLGWEGLKYLWNLLLYWGRELKXSAINLLDTIAIAVAGWTDRVIEIGQRIGRAILNIPRRIRQGLERALL

SEQ ID NO: 1486 - protein, 204 aa, Human immunodeficiency virus
MGGKWSKSSIVGWPQVRERIKQTPPAAEGVGAVSQDLDKHGAVTSSNMNNADCVWLRAQEEEGVGFPVRPQVPLRPMTYKGAFDLSFFLKEKGGLEGLVYSKKRQEILDLWVYHTQGFFPDWHNYTPGPGIRYPLCFGWCFKLVPVDPREVEEDNKGENNCLLHPMSQHGIEDEEREVLIWKFDSALARRHIARELRPEFYKDC

SEQ ID NO: 1487 - protein, 209 aa, Artificial
  NEF Consensus A
  MISC_FEATURE (24)..(24): X = unknown amino acid
  MISC_FEATURE (50)..(51): X = unknown amino acid
  MISC_FEATURE (61)..(61): X = unknown amino acid
  MISC_FEATURE (65)..(65): X = unknown amino acid
  MISC_FEATURE (68)..(68): X = unknown amino acid
  MISC_FEATURE (107)..(107): X = unknown amino acid
  MISC_FEATURE (161)..(161): X = unknown amino acid
  MISC_FEATURE (180)..(180): X = unknown amino acid
  MISC_FEATURE (199)..(199): X = unknown amino acid
MGGKWSKSSIVGWPEVRKRMRQTXPTAAKGVGAVSQDLDKHGAITSSNTXXTNPSCAWLEXAQEXDEXVGFPVRPQVPLRPMTYKGAVDLSHFLKEKGGLDGLIYSXKRQEILDLWVYNTQGFFPDWQNYTPGPGTRFPLTFGWCFKLVPVDPAEVEEATXGENNSLLHPICQHGMDDEXREVLMWKFDSRLALKHRAXELHPEFYKDC

SEQ ID NO: 1488 - protein, 207 aa, Human immunodeficiency virus
MGGTMSKCSPVGWPAIRERIRRAAPAAEGVGAASRDLDKYGALTSSNTPANNPDCAWLEAQEEEEEVGFPVRPQVPLRPMTYKAAFDLSLFLKEKGGLEGLIYSKKRQEILDLWVYNTQGFFPDWQNYTPGPGVRYPLTFGWCFKLVPVDPSEVEEINEGENNCLLHPASLHGMEDEDREVLKWKFDSHLARRHMARELHPEYYKDC

SEQ ID NO: 1489 - DNA, 14 bp, Artificial
  BamHI/Kozak Start
gcggatccaccatg

SEQ ID NO: 1490 - DNA, 23 bp, Artificial
  SalI/Stop/BglII/EcoRI
gtcgactgaagatctgaattcgc

SEQ ID NO: 1491 - DNA, 20 bp, Artificial
  BamHI/Kozak Start XhoI
gcggatccaccatgctcgag

SEQ ID NO: 1492 - DNA, 23 bp, Artificial
  XhoI/Stop/BglII/EcoRI
ctcgagtgaagatgtgaattcgc

SEQ ID NO: 1493 - DNA, 17 bp, Artificial
  Stop/BglII/EcoRI
tgaagatctgaattcgc

SEQ ID NO: 1494 - DNA, 14 bp, Artificial
  SC1 SpeI/EcoRI
actagtgaattcgc

SEQ ID NO: 1495 - DNA, 14 bp, Artificial
  SC2 BamHI/XbaI
gcggatcctctaga

SEQ ID NO: 1496 - DNA, 14 bp, Artificial
  SC2 NheI/EcoRI
gctagcgaattcgc

SEQ ID NO: 1497 - DNA, 14 bp, Artificial
  SC3 BamHI/SpeI
gcggatccactagt

SEQ ID NO: 1498 - DNA, 14 bp, Artificial
  SC3 AvrII/EcoRI
cctagggaattcgc

SEQ ID NO: 1499 - DNA, 14 bp, Artificial
  SC4 BamHI/NheI
gcggatccgctagc

SEQ ID NO: 1500 - DNA, 14 bp, Artificial
  SC4 XbaI/EcoRI
tctagagaattcgc

SEQ ID NO: 1501 - DNA, 14 bp, Artificial
  SC5 BamHI/SpeI
gcggatccactagt

SEQ ID NO: 1502 - DNA, 14 bp, Artificial
  SC5 AvrII/EcoRI
ccatgggaattcgc

SEQ ID NO: 1503 - DNA, 14 bp, Artificial
  SC6 BamHI/NheI
gcggatccgctagc

SEQ ID NO: 1504 - DNA, 14 bp, Artificial
  SC6 XbaI/EcoRI
tctagagaattcgc

SEQ ID NO: 1505 - DNA, 14 bp, Artificial
  SC7 BamHI/NheI
gcggatccgctagc

SEQ ID NO: 1506 - DNA, 14 bp, Artificial
  SC7 SpeI/EcoRI
actagtgaattcgc

SEQ ID NO: 1507 - DNA, 14 bp, Artificial
  SC8 BamHI/XbaI
gcggatcctctaga

What is claimed is:

1. A synthetic polypeptide comprising at least three different segments of an HIV polypeptide, wherein the size of each segment is from about 20 to about 60 amino acids, wherein the segments are linked together in the same polypeptide chain but in a different relationship relative to their linkage in said HIV polypeptide, wherein the linkage of the segments impedes, abrogates or otherwise alters at least one function associated with said HIV polypeptide, wherein the sequence of any plurality of segments so linked is different from a sequence contained within said HIV polypeptide, wherein the sequence of at least one of said segments overlaps with the sequence of at least one other of said segments, wherein the sequence overlap is at least 4 contiguous amino acids in length, and wherein the synthetic polypeptide comprises at least 30% of the sequence of said HIV polypeptide.

2. The synthetic polypeptide of claim 1, further comprising a segment from at least one other polypeptide.

3. The synthetic polypeptide of claim 1, further comprising different segments from at least one other polypeptide, wherein the segments are linked together in a different relationship relative to their linkage in the at least one other polypeptide to impede, abrogate or otherwise alter at least one function associated with the at least one other polypeptide, and wherein the sequence of any plurality of segments so linked is different from a sequence contained within said at least one other polypeptide.

4. The synthetic polypeptide of claim 1, wherein the segments in said synthetic polypeptide are linked sequentially in a different order or arrangement relative to their linkage in said HIV polypeptide.

5. The synthetic polypeptide of claim 1, wherein the segments in said synthetic polypeptide are randomly rearranged relative to their linkage in said HIV polypeptide.

6. The synthetic polypeptide of claim 1, wherein the size of an individual segment is from about 20 to about 30 amino acids.

7. The synthetic polypeptide of claim 6, wherein the size of an individual segment is about 30 amino acids.

8. The synthetic polypeptide of claim 1, wherein the sequence overlap is contained at one or both ends of an individual segment.

9. The synthetic polypeptide of claim 1, wherein an optional spacer is interposed between some or all of the segments.

10. The synthetic polypeptide of claim 9, wherein the spacer alters proteolytic processing and/or presentation of adjacent segment(s).

11. The synthetic polypeptide of claim 10, wherein the spacer comprises at least one alanine residue.

12. The synthetic polypeptide of claim 10, wherein the spacer comprises at least one alanine residue.

13. The synthetic polypeptide of claim 1, wherein the at least one parent polypeptide is selected from the group consisting of env, gag, pol, vif, vpr, tat, rev, vpu and nef, or a combination thereof.

14. A method for producing the synthetic polynucleotide according to claim 1, said method comprising:
    linking together in the same reading frame nucleic acid sequences encoding the plurality of different segments; and
    expressing the nucleotide sequences to produce said synthetic polypeptide.

15. The method of claim 14, further comprising segmenting the sequence of an individual parent polypeptide into segments and linking said segments together in a different relationship relative to their linkage in the individual parent polypeptide sequence.

16. The method of claim 15, wherein the segments are randomly linked together.

17. The method of claim 14, further comprising reverse translating the sequence of an individual parent polypeptide or a segment thereof to provide a nucleic acid sequence encoding said parent polypeptide or said segment.

18. The method of claim 17, wherein an amino acid of an individual parent polypeptide sequence is reverse translated to provide a codon, which has higher translational efficiency than other synonymous codons in a cell of interest.

19. The method of claim 17, wherein an amino acid of an individual parent polypeptide sequence is reverse translated to provide a codon which, in the context of adjacent or local sequence elements, has a lower propensity of forming an undesirable sequence that is refractory to the execution of a task selected from the group consisting of cloning and sequencing.

20. The method of claim 17, wherein an amino acid of an individual parent polypeptide sequence is reverse translated to provide a codon which, in the context of adjacent or local sequence elements, has a lower propensity of forming an undesirable sequence selected from a palindromic sequence or a duplicated sequence, which is refractory to the execution of a task selected from the group consisting of cloning or sequencing.

21. The method of claim 14, further comprising linking a spacer oligonucleotide encoding at least one spacer residue between segment-encoding nucleic acids.

22. The method of claim 21, wherein spacer oligonucleotide encodes 2 to 3 spacer residues.

23. A composition comprising the synthetic polypeptide of claim 1, and a pharmaceutically acceptable carrier.

24. The composition of claim 23, further comprising an adjuvant.

25. A method for inducing an immune response comprising administering to a patient in need thereof an effective amount of an immunopotentiating agent selected from the group consisting of:
    a) the synthetic polypeptide of claim 1,
    b) a synthetic polynucleotide encoding the synthetic polypeptide of a) above,
    c) a synthetic construct comprising a synthetic polynucleotide encoding the synthetic polypeptide of b) above wherein the synthetic polynucleotide is operably linked to a regulatory polynucleotide, and
    d) a composition wherein said composition comprises an immunopotentiating agent selected from the group consisting of a) above, b) above and c) above, and a pharmaceutically acceptable carrier.

26. The method of claim 24, wherein the spacer residue is a neutral amino acid.

27. The method of claim 24, wherein the space residue is alanine.

28. The method of claim 25, wherein the immune response is directed against HIV.

29. The synthetic polypeptide of claim 1, wherein the overlap is about 15 amino acids.

30. The synthetic polypeptide of claim 1, wherein said segments are from HIV gag or env.

31. The synthetic peptide of claim 1, wherein said segments have a sequence selected from the group consisting of SEQ ID NOs: 11, 13, 15, 17, 19, 21, 23, 25, 27, 29, 31, 33, 35, 37, 39, 41, 43, 45, 47, 49, 51, 53, 55, 57, 59, 61, 63, 65, 67, 69, 71, 73, 75, 281, 283, 285, 287, 289, 291, 293, 295, 297, and 299.

32. The synthetic polypeptide of claim 1, wherein the sequence overlap is at least 7 contiguous amino acids in length.

33. The synthetic polypeptide of claim 1, wherein the sequence overlap is at least 10 contiguous amino acids in length.

34. The synthetic polypeptide of claim 1, wherein the sequence overlap is at least 15 contiguous amino acids in length.

35. The synthetic polypeptide of claim 1, wherein the sequence overlap is at least 20 contiguous amino acids in length.

* * * * *

UNITED STATES PATENT AND TRADEMARK OFFICE
CERTIFICATE OF CORRECTION

| | | |
|---|---|---|
| PATENT NO. | : 7,820,786 B2 | Page 1 of 2 |
| APPLICATION NO. | : 10/296734 | |
| DATED | : October 26, 2010 | |
| INVENTOR(S) | : Scott Anthony Thomson and Ian Alistair Ramshaw | |

It is certified that error appears in the above-identified patent and that said Letters Patent is hereby corrected as shown below:

In column 6, line 47, Change "lade" to --clade--.

In column 6, line 67, Change "lade" to --clade--.

In column 7, line 10, Change "lade" to --clade--.

In column 7, line 20, Change "lade" to --clade--.

In column 7, line 30, Change "lade" to --clade--.

In column 9, line 18, Change "pooh" to --pool1--.

In column 55, line 50, Change "thereof" to --thereof.--.

In column 61 (Table C), line 11, Change "D-valin" to --D-valine--.

In column 63, line 39, Change "Extehsion" to --Extension--.

In column 72, line 24, Change "lade" to --clade--.

In column 72, line 34, Change "lade," to --clade,--.

In column 72, line 34, Change "lade" to --clade--.

In column 72, line 37, Change "cldade D" to --cladeD--.

In column 73, line 14, After "sequences for" insert --each HIV clade compiled by the Los Alamos HIV sequence database (Figures 3-11) (HIV--.

In column 73, line 20, Change "ladeE and ladeC," to --cladeE and cladeC,--.

In column 75, line 20, Change "fictional" to --functional--.

In column 77, line 37, Change "safety" to --safety.--.

In column 77, line 57, Change "lade" to --clade--.

In column 78, line 38, Change "lade" to --clade--.

In column 82, line 52, Change "epidernic" to --epidemic--.

In column 85, line 23, In Claim 11, change "alanine residue." to --neutral amino acid.--.

In column 85, line 30, In Claim 14, change "polynucleotide" to -- polypeptide--.

Signed and Sealed this
Seventeenth Day of May, 2011

David J. Kappos
*Director of the United States Patent and Trademark Office*

In column 86, line 5, In Claim 20, change "or" to --and--.